(12) United States Patent
Olson et al.

(10) Patent No.: US 11,058,767 B2
(45) Date of Patent: Jul. 13, 2021

(54) CAMK2D ANTISENSE OLIGONUCLEOTIDES AND USES THEREOF

(71) Applicants: Bristol-Myers Squibb Company, Princeton, NJ (US); Roche Innovation Center Copenhagen A/S, Hørsholm (DK)

(72) Inventors: Richard E. Olson, Cambridge, MA (US); Brian R. Anderson, Princeton, NJ (US); Peter Hagedorn, Hørsholm (DK); Marianne Lerbech Jensen, Køge (DK); Ivar M. McDonald, East Haddam, CT (US); Stephen E. Mercer, Middletown, CT (US)

(73) Assignees: BRISTOL-MYERS SQUIBB COMPANY, Princeton, NJ (US); ROCHE INNOVATION CENTER COPENHAGEN A/S, Horsholm (DK)

( * ) Notice: Subject to any disclaimer, the term of this patent is extended or adjusted under 35 U.S.C. 154(b) by 0 days.

(21) Appl. No.: 16/282,138

(22) Filed: Feb. 21, 2019

(65) Prior Publication Data
US 2019/0275148 A1    Sep. 12, 2019

Related U.S. Application Data

(60) Provisional application No. 62/633,502, filed on Feb. 21, 2018, provisional application No. 62/635,954, filed on Feb. 27, 2018, provisional application No. 62/665,998, filed on May 2, 2018, provisional application No. 62/778,679, filed on Dec. 12, 2018.

(51) Int. Cl.
| | |
|---|---|
| *C07H 21/02* | (2006.01) |
| *C07H 21/04* | (2006.01) |
| *A61K 39/395* | (2006.01) |
| *A61K 47/54* | (2017.01) |
| *A61K 47/64* | (2017.01) |
| *A61K 47/60* | (2017.01) |
| *A61P 9/12* | (2006.01) |
| *A61P 9/04* | (2006.01) |
| *A61K 9/00* | (2006.01) |
| *C12N 5/074* | (2010.01) |
| *C12N 5/077* | (2010.01) |
| *C12N 15/113* | (2010.01) |
| *A61K 31/713* | (2006.01) |
| *A61K 39/00* | (2006.01) |

(52) U.S. Cl.
CPC ...... *A61K 39/39541* (2013.01); *A61K 9/0017* (2013.01); *A61K 9/0019* (2013.01); *A61K 31/713* (2013.01); *A61K 47/542* (2017.08); *A61K 47/549* (2017.08); *A61K 47/60* (2017.08); *A61K 47/64* (2017.08); *A61P 9/04* (2018.01); *A61P 9/12* (2018.01); *C12N 5/0607* (2013.01); *C12N 5/0657* (2013.01); *C12N 15/113* (2013.01); *C12N 15/1137* (2013.01); *A61K 2039/505* (2013.01); *C12N 2310/11* (2013.01); *C12N 2310/315* (2013.01); *C12N 2310/3231* (2013.01); *C12N 2310/3341* (2013.01); *C12N 2310/341* (2013.01); *C12N 2310/351* (2013.01); *C12N 2310/3525* (2013.01); *C12N 2320/30* (2013.01); *C12Y 207/11017* (2013.01)

(58) Field of Classification Search
CPC .. C12N 15/113; C12N 15/111; C12N 2310/11
See application file for complete search history.

(56) References Cited

U.S. PATENT DOCUMENTS

| | | | |
|---|---|---|---|
| 4,683,195 A | 7/1987 | Mullis | |
| 8,841,423 B2 | 9/2014 | Anderson et al. | |
| 9,090,701 B2 | 7/2015 | Anderson et al. | |
| 2004/0101855 A1* | 5/2004 | Bennett | C07H 21/04 435/6.18 |
| 2005/0085436 A1 | 4/2005 | Li et al. | |
| 2012/0122954 A1* | 5/2012 | Straarup | C12N 9/6454 514/44 A |
| 2012/0322851 A1 | 12/2012 | Hardee et al. | |
| 2014/0199245 A1* | 7/2014 | McNamara, II | C12Q 1/44 424/9.6 |

FOREIGN PATENT DOCUMENTS

| | | | |
|---|---|---|---|
| CN | 1904900 A * | 1/2007 | .......... C12N 15/113 |
| JP | 2006223228 A | 8/2006 | |
| WO | WO-1993007883 A1 | 4/1993 | |
| WO | WO-1998021366 A1 | 5/1998 | |
| WO | WO-1998039352 A1 | 9/1998 | |
| WO | WO-1999014226 A2 | 3/1999 | |
| WO | WO-2000047599 A1 | 8/2000 | |
| WO | WO-2000066604 A2 | 11/2000 | |
| WO | WO-2001023613 A1 | 4/2001 | |

(Continued)

OTHER PUBLICATIONS

Qiu et al. (Peptides, 29, 2008, 2052-2060).*
Majlessi et al. (Nucleic Acids Research, 1998, vol. 26, No. 9, pp. 2224-2229).*
Abe et al. (PNAS, 2006, vol. 103, No. 2, 263-268).*
Vickers et al. (The Journal of Biological Chemistry, 278, 9, 7108-7118, 2003).*
Barciszewski, J., et al., "Chapter 10—Locked Nucleic Acid Aptamers," Nucleic Acid and Peptide Aptamers: Methods and Protocols 535:165-186.

(Continued)

*Primary Examiner* — Amy H Bowman
(74) *Attorney, Agent, or Firm* — Sterne, Kessler, Goldstein & Fox P.L.L.C.; Ji Eun Kim

(57) ABSTRACT

The present disclosure relates to antisense oligonucleotides, which target CAMK2D mRNA in a cell, leading to reduced expression of CAMK2D protein. Reduction of CAMK2D protein expression is beneficial for the treatment of certain medical disorders, e.g., cardiovascular-related diseases or disorders.

17 Claims, 103 Drawing Sheets
Specification includes a Sequence Listing.

(56) References Cited

FOREIGN PATENT DOCUMENTS

| WO | WO-2001057189 A2 | 8/2001 | |
|---|---|---|---|
| WO | WO-2003016475 A2 | 2/2003 | |
| WO | WO-2003039443 A2 | 5/2003 | |
| WO | WO-2003065006 A2 | 8/2003 | |
| WO | WO-2004012817 A2 | 2/2004 | |
| WO | WO-2004033476 A1 | 4/2004 | |
| WO | WO-2004046160 A2 | 6/2004 | |
| WO | WO-2004071413 A2 | 8/2004 | |
| WO | WO-2005060667 A2 | 7/2005 | |
| WO | WO-2007031091 A2 | 3/2007 | |
| WO | WO-2007059533 A2 | 5/2007 | |
| WO | WO-2007090071 A2 | 8/2007 | |
| WO | WO-2007101306 A1 | 9/2007 | |
| WO | WO-2007134181 A2 | 11/2007 | |
| WO | WO-2007146511 A2 | 12/2007 | |
| WO | WO-2008020435 A2 | 2/2008 | |
| WO | WO-2008025073 A1 | 3/2008 | |
| WO | WO-2008026075 A2 | 3/2008 | |
| WO | WO-2008113832 A2 | 9/2008 | |
| WO | WO 2008/152636 A2 * | 12/2008 | ........... A61K 31/713 |
| WO | WO-2008150729 A2 | 12/2008 | |
| WO | WO-2008154401 A2 | 12/2008 | |
| WO | WO-2009006478 A2 | 1/2009 | |
| WO | WO-2009067647 A1 | 5/2009 | |
| WO | WO-2010036698 A1 | 4/2010 | |
| WO | WO-2010040571 A2 | 4/2010 | |
| WO | WO-2010077578 A1 | 7/2010 | |
| WO | WO-2010120969 A1 | 10/2010 | |
| WO | WO-2011017521 A2 | 2/2011 | |
| WO | WO-2011156202 A1 | 12/2011 | |
| WO | WO-2012024255 A2 | 2/2012 | |
| WO | WO-2013023084 A2 | 2/2013 | |
| WO | WO-2013033230 A1 | 3/2013 | |
| WO | WO-2013033657 A2 | 3/2013 | |
| WO | WO-2013036868 A1 | 3/2013 | |
| WO | WO-2013151999 A1 | 10/2013 | |
| WO | WO-2013154798 A1 | 10/2013 | |
| WO | WO-2014076195 A1 | 5/2014 | |
| WO | WO-2014076196 A1 | 5/2014 | |
| WO | WO-2014077693 A1 | 5/2014 | |
| WO | WO-2014138212 A1 | 9/2014 | |
| WO | WO-2014179492 A1 | 11/2014 | |
| WO | WO-2014179620 A1 | 11/2014 | |
| WO | WO-2014207232 A1 | 12/2014 | |
| WO | WO-2016037106 A1 | 3/2016 | |
| WO | WO-2016126747 A1 | 8/2016 | |
| WO | WO-2016170348 A2 | 10/2016 | |
| WO | WO 2017/011286 A1 * | 1/2017 | ........... A61K 31/713 |
| WO | WO-2017053995 A1 | 3/2017 | |
| WO | WO-2017053999 A1 | 3/2017 | |
| WO | WO 2017/106283 A1 * | 6/2017 | ........... A61K 31/713 |
| WO | WO 2018/007980 A1 * | 1/2018 | ........... C12N 15/113 |
| WO | WO-2018025085 A2 | 2/2018 | |
| WO | WO-2019049148 A1 | 3/2019 | |
| WO | WO-2019143847 A1 | 7/2019 | |
| WO | WO-2019165067 A1 | 8/2019 | |
| WO | WO-2019217459 A1 | 11/2019 | |

OTHER PUBLICATIONS

Benjamin, E.J., et al., "Heart Disease and Stroke Statistics—2017 Update: A Report From the American Heart Association," Circulation 135(10):e146-e603, American Heart Association, United States (2017).

Blazeski, A., et al., "Cardiomyocytes derived from human induced pluripotent stem cells as models for normal and diseased cardiac electrophysiology and contractility," Prog Biophys Mol Biol 110(0):166-177, Elsevier, Netherlands (2012).

Braun, A.P., et al., "The Multifunctional Calcium/Calmodulin-Dependent Protein Kinase: From Form to Function," Annual Review of Physiology 57:417-445, Annual Reviews, United States (1995).

Hadijiloizou, N., et al., "Differences in cardiac microcirculatory wave patterns between the proximal left mainstem and proximal right coronary artery," Am J Physiol Heart Circ Physiol 295(3):H1198-H1205, American Physiological Society, United States (2008).

Mattiazzi, A., et al., "Chasing cardiac physiology and pathology down the CAMKII cascade," Am J Heart Circ Physiol. 308(10): H1177-H1191, American Physiological Society, United States (2015).

Zhang, J., et al., "Functional Cardiomyocytes derived from human induced pluripotent stem cells," Circ Res. 104(4):e30-41, Lippincott Williams & Wilkins, United States (2009).

Anderson, M.E., et al., "CaMKII in myocardial hypertrophy and heart failure," 51:468-473, Elsevier, Netherlands (2011).

Backs, J., et al., "The δ isoform of CaM kinase II is required for pathological cardiac hypertrophy and remodeling after pressure overload," PNAS 106(7):2342-2347, Proceedings of the national Academy of Sciences of the United States of America, United States (2009).

Beauverger, P., et al., "Reversion of cardiac dysfunction by a novel orally available calcium/calmodulin-dependent protein kinase II inhibitor, RA306, in a genetic model of dilated cardiomyopathy," Cardiovascular Research: 1-10, European Society of Cardiology, United Kingdom (2019).

Bezzerides, V., et al., "Gene Therapy for Catecholaminergic Polymorphic Ventricular Tachycardia by Inhibition of $Ca^{2+}$/Calmodulin-Dependent Kinase II." Circulation: 140(5):405-419, Lippincott Williams & Wilkins, United States (2019).

Dewenter, M., et al., "Calcium/Calmodulin-Dependent Protein Kinase II Activity Persists During Chronic β-Adrenoceptor Blockade in Experimental and Human Heart Failure," Circ Heart Fail 10(5): 2003840, American Heart Association, United States (2017).

International Search Report and Written Opinion for PCT/US2019/018947, European Patent Office, Netherlands, dated Aug. 13, 2019, 24 pages.

Kim, I., et al., "Ca2+calmodulin in-dependent protein kinases II-dependent activation of contractility in ferret aorta," Journal of Physiology 526:367-374, Wiley Online Library (2000).

Kreusser, M.M., et al., "Cardiac CaM Kinase II Genes δ and γ Contribute to Adverse Remodeling but Redundantly Inhibit Calcineurin-Induced Myocardial Hypertrophy," Circulation 130(15):1262-1273, Lippincott Williams &Wilkins, United States (2014).

Kreusser, M.M., et al., "Integrated mechanisms of CaMKII-dependent ventricular remodeling," Frontiers in Pharmacology 5(36):1-8, Pharmacology of Ion Channels and Channelopathies, United States (2014).

Kreusser, M.M., et al., "Inducible cardiomyocyte-specific deletion of CaM kinase II protects from pressure overload-induced heart failure," Basic Res Cardiol 111(65):1-9, Springer Business, United States (2016).

Lebek, S., et al., "The novel CaMKII inhibitor GS-680 reduces diastolic SR Ca leak and prevents CaMKII-dependent pro-arrhythmic activity," Journal of Molecular and Cellular Cardiology 118:159-168, Elsevier, Netherlands (2018).

Ling, H., et al., "Requirement for Ca2+/calmodulin-dependent kinase II in the transition from pressure overload-induced cardiac hypertrophy to heart failure in mice," The Journal of Clinical Investigation 119(5):1230-1240, American Society for Clinical Investigation, United States (2009).

Maier, L.S., "CaMKII[delta] overexpression in hypertrophy and heart failure: cellular consequences for excitation-contraction coupling," Brazilian Journal of Medical Biological Research 38:1293-1302, Associacao Brasileria de Divulgacao Cientifica, Brazil (2005).

Pellicena, P., et al., "CaMKII inhibitors: from research tools to therapeutic agents." Front Pharmacol 5(21): 10 pages, Frontiers in Pharmacology, United States (2014).

Purohit, A., et al., "Oxidized Ca2+/Calmodulin-Dependent Protein Kinase II Triggers Atrial Fibrillation," Circulation 128(16): 1748-1757, Lippincott Williams &Wilkins, United States (2013).

Rajtik, T., et al., "Posttranslational modifications of calcium/calmodulin-dependent protein kinase IIδ and its downstream signaling in human failing hearts," Am J. Transl Res 9(8):3573-3585, American Journal of Translational Research, United States (2017).

Said, M., et al., "Role of dual-site phospholamban phosphorylation in the stunned heart: insights from phospholamban site-specific mutants." Am J Physiol Heart Circ Physiol 285(3): H1198-205 (2003).

(56) References Cited

OTHER PUBLICATIONS

Sequence 99675 from Patent EP2850184, XP002791546, retrieved from EM_PAT: JD784807, Database accession No. JD784807 sequence, 1 page, 1 page, dated May 21, 2019.
Sequence 234707 from U.S. Pat. No. 7,374,927, XP002791545, retrieved from EM_PAT:GC034707, Database accession No. GC034707 sequence,1 page, dated May 22, 2019.
Simonson, B., et al., "MicroRNA Therapeutics: the Next Magic Bullet?" Mini Rev Med Chem 15(6): 467-74 (2015).
Willeford, A., et al., "CaMKIIδ-mediated inflammatory gene expression and inflammasome activation in cardiomyocytes initiate inflammation and induce fibrosis," JCI Insight 3(12): e97054, American Society for Clinical Investigation, United States (2018).
Zhang, R., et al., "Calmodulin kinase II inhibition protects against structural heart disease," Nature Medicine 11(4):409-417, Nature Publishing Group, United Kingdom (2005).
Altschul, S.F., and Gish, W., "Local alignment statistics," *Methods in Enzymology 266*: 460-480, Academic Press Inc., United States (1996).
Altschul, S.F., et al., "Gapped BLAST and PSI-BLAST: A New Generation of Protein Database Search Programs," *Nucleic Acids Research* 25(17):3389-3402, Oxford University Press, United Kingdom (1997).
Bergstrom, D.E., "Unnatural Nucleosides with Unusual Base Pairing Properties," *Curr Protoc Nucleic Acid Chem* 37(1):1.4.1-1.4.32, John Wiley and Sons Inc., United States (2009).
Caruthers, M.H., et al., "Chemical synthesis of deoxyoligonucleotides by the phosphoramidite method," *Methods in Enzymology* 154:287-313, Academic Press Inc., United States (1987).
Dass, C.R., "Vehicles for oligonucleotide delivery to tumours," *Journal of Pharmacy and Pharmacology* 54(1):3-27, Wiley-Blackwell, United States (2002).
Deleavey, G.F., and Damha, M.J., "Designing chemically modified oligonucleotides for targeted gene silencing," *Chemistry & Biology* 19(8):937-54, Cell Press, United States (2012).
Freier, S.M., and Altmann, K.H., "The ups and downs of nucleic acid duplex stability: structure-stability studies on chemically-modified DNA:RNA duplexes," *Nucleic Acids Res* 25(22):4429-4443, Oxford University Press, United Kingdom (1997).
GenBank, "*Homo sapiens* chromosome 4, GRCh38.p13 Primary Assembly," Accession No. NC_000004.12, accessed at https://www.ncbi.nlm.nih.gov/nuccore/NC_000004.12, accessed on Oct. 20, 2020, 2 pages.
GenBank, "*Homo sapiens* calcium/calmodulin dependent protein kinase II delta (CAMK2D), transcript variant 3, mRNA," Accession No. NM_001221.3, accessed at https://www.ncbi.nlm.nih.gov/nuccore/NM_001221.3, accessed on Oct. 20, 2020, 7 pages.
GenBank, "*Homo sapiens* calcium/calmodulin dependent protein kinase II delta (CAMK2D), transcript variant 7, mRNA," Accession No. NM_001321566.2, accessed at https://www.ncbi.nlm.nih.gov/nuccore/NM_001321566.2, accessed on Oct. 20, 2020, 5 pages.
GenBank, "Calcium/calmodulin-dependent protein kinase type II subunit delta isoform 6 [*Homo sapiens*]," Accession No. NP_001308495.1, accessed at https://www.ncbi.nlm.nih.gov/protein/NP_001308495.1, accessed on Oct. 20, 2020, 3 pages.
Hansen, L.D., et al., "Entropy titration. A calorimetric method for the determination of $\Delta G°(K)$, $\Delta H°$ and $\Delta S°$," *Chemical Communications (London)* 3:36-38, Royal Society of Chemistry, United Kingdom (1965).
Hirao, I., et al., "Natural versus Artificial Creation of Base Pairs in DNA: Origin of Nucleobases from the Perspectives of Unnatural Base Pair Studies," *Acc Chem Res* 45(12):2055-2065, American Chemical Society, United States (2012).
Holdgate, G.A., et al., "Measurements of binding thermodynamics in drug discovery," *Drug Discovery Today* 10(22):1543-1550, Elsevier Ltd., Netherlands (2005).
Karlin, S., and Altschul, S.F., "Methods for assessing the statistical significance of molecular sequence features by using general scoring schemes," *Proc Natl Acad Sci USA* 87(6):2264-2268, National Academy of Sciences, United States (1990).
Karlin, S., and Altschul, S.F., "Applications and statistics for multiple high-scoring segments in molecular sequences," *Proc Natl Acad Sci USA* 90(12):5873-5877, National Academy of Sciences, United States (1993).
Manoharan, M., "Oligonucleotide conjugates as potential antisense drugs with improved uptake, biodistribution, targeted delivery, and mechanism of action," *Antisense and Nucleic Acid Drug Development* 12(2):103-28, Mary Ann Liebert Inc., United States (2002).
McTigue, P.M., et al., "Sequence-dependent thermodynamic parameters for locked nucleic acid (LNA)-DNA duplex formation," *Biochemistry* 43(18):5388-5405, American Chemical Society, United States (2004).
Mergny, J-L., and Lacroix, L., "Analysis of thermal melting curves," *Oligonucleotides* 13(6):515-537, Mary Ann Liebert Inc., United States (2003).
Mitsuoka, Y., et al., "A bridged nucleic acid, 2',4'-BNA COC: synthesis of fully modified oligonucleotides bearing thymine, 5-methylcytosine, adenine and guanine 2',4'-BNA COC monomers and RNA-selective nucleic-acid recognition," *Nucleic Acids Res* 37(4):1225-1238, Oxford University Press, United States (2009).
Morita, K., et al., "2'-O,4'-C-ethylene-bridged nucleic acids (ENA): highly nuclease-resistant and thermodynamically stable oligonucleotides for antisense drug," *Bioorganic & Medicinal Chemistry Letters* 12(1):73-76, Elsevier Ltd., United Kingdom (2002).
Morita, K., et al., "Synthesis and properties of 2'-O,4'-C-ethylene-bridged nucleic acids (ENA) as effective antisense oligonucleotides," *Bioorganic & Medicinal Chemistry* 11(10):2211-2226, Elsevier Ltd., United Kingdom (2003).
Myers, E.W., and Miller, W., "Optimal Alignment in Linear Space," *Computer Applications in the Biosciences* 4(1):1-13, Oxford University Press, United Kingdom (1988).
Needleman, S.B. and Wunsch, C.D., "A General Method Applicable to the Search for Similarities in the Amino Acid Sequence of Two Proteins," *Journal of Molecular Biology* 48(3):443-453, Academic Press, United Kingdom (1970).
Santalucia, J., Jr., "A unified view of polymer, dumbbell, and oligonucleotide DNA nearest-neighbor thermodynamics," *Proc Natl Acad Sci USA* 95(4):1460-1465, National Academy of Sciences, United States (1998).
Seth, P.P., et al., "Synthesis and biophysical evaluation of 2',4'-constrained 2'O-methoxyethyl and 2',4'-constrained 2'O-ethyl nucleic acid analogues," *J Org Chem* 75(5):1569-81, American Chemical Society, United States (2010).
Stowe, R.P., et al., "Detection and quantification of Epstein-Barr Virus EBER1 in EBV-infected cells by fluorescent in situ hybridization and flow cytometry," *Journal of Virological Methods* 75:83-91, Elsevier, Netherlands (1998).
Sugimoto, N., et al., "Thermodynamic parameters to predict stability of RNA/DNA hybrid duplexes," *Biochemistry* 34(35):11211-11216, American Chemical Society, United States (1995).
Touboul, M., et al., "Early detection of chemoresistance in vivo through the use of a radiolabeled antisense oligonucleotide," *Anticancer Res* 22(6A):3349-56, International Institute of Anticancer Research, Greece (2002).
Uhlmann, E., "Recent advances in the medicinal chemistry of antisense oligonucleotides," *Current Opinion in Drug Discovery & Development* 3(2):203-213, Current Drugs Ltd., United Kingdom (2000).
UniProtKB, "CAMK2D—Calcium/calmodulin-dependent protein kinase type II subunit delta," Accession No. Q13557, accessed at https://www.uniprot.org/uniprot/O13557, accessed at Oct. 20, 2020, 13 pages.
Verjat, T., et al., "Detection of 8-oxoG DNA glycosylase activity and OGG1 transcripts in the rat CNS," *Mutation Research* 460(2):127-38, Elsevier, Netherlands (2000).
Zhang, M., et al., "CaMKII-δ9 promotes cardiomyopathy through disrupting UBE2T-dependent DNA repair," *Nat Cell Biol* 21(9):1152-1163, Nature Publishing Group, United Kingdom (Sep. 2019).

\* cited by examiner

FIG. 1A

| SEQ ID No. | Start (SEQ ID NO: 1) | End (SEQ ID NO: 1) | ASO Sequence | ASO No. | ASO with Chemical Structure |
|---|---|---|---|---|---|
| 4 | 725 | 739 | CGAAAGTAGCTCGCC | ASO-0095 | OxyMCs OxyGs OxyAs DNAgs DNAts DNAgs DNAcs DNAts DNAmcs DNAgs OxyMCs OxyMC |
| 5 | 725 | 740 | CCGAAAGTAGCTCGCC | ASO-0096 | OxyMCs DNAmcs DNAgs DNAas DNAgs DNAts DNAgs DNAcs DNAts DNAmcs DNAgs OxyMCs OxyMC |
| 6 | 726 | 739 | CGAAAGTAGCTCGC | ASO-0097 | OxyMCs OxyGs OxyAs DNAas DNAgs DNAts DNAgs DNAcs OxyTs OxyMCs OxyGs OxyMC |
| 7 | 726 | 740 | CCGAAAGTAGCTCGC | ASO-0098 | OxyMCs OxyMCs DNAgs DNAas DNAgs DNAts DNAgs DNAcs OxyTs OxyMCs OxyGs OxyMC |
| 8 | 726 | 741 | TCCGAAAGTAGCTCGC | ASO-0099 | OxyTs OxyMCs DNAmcs DNAgs DNAas DNAgs DNAts DNAgs DNAcs OxyTs OxyMCs OxyGs OxyMC |
| 9 | 726 | 742 | GTCCGAAAGTAGCTCGC | ASO-0100 | OxyGs DNAts DNAcs DNAmcs DNAgs DNAas DNAgs DNAts DNAgs DNAcs OxyTs OxyMCs OxyGs OxyMC |
| 10 | 727 | 741 | TCCGAAAGTAGCTCG | ASO-0101 | OxyTs OxyMCs OxyMCs OxyGs DNAas DNAgs DNAts DNAgs DNAcs OxyTs OxyMCs OxyG |
| 11 | 727 | 742 | GTCCGAAAGTAGCTCG | ASO-0102 | OxyGs OxyTs OxyMCs OxyMCs DNAgs DNAas DNAgs DNAts DNAgs DNAcs OxyTs OxyMCs OxyG |
| 12 | 728 | 742 | GTCCGAAAGTAGCTC | ASO-0103 | OxyGs OxyTs OxyMCs OxyMCs DNAgs DNAgs DNAas DNAgs DNAcs OxyTs OxyMC |
| 13 | 1498 | 1514 | TGGATATAGGGCAAGGG | ASO-0104 | OxyTs DNAgs DNAgs DNAas DNAts DNAas DNAts DNAas DNAgs DNAgs DNAgs OxyGs DNAgs OxyGs OxyG |
| 14 | 1539 | 1554 | AGAATGATGGTGAGCG | ASO-0105 | OxyAs OxyGs OxyAs OxyAs DNAts DNAgs DNAas DNAts DNAgs DNAgs OxyGs OxyG |
| 15 | 1796 | 1812 | AGGAATTGGGTTTGGGT | ASO-0106 | OxyAs DNAgs DNAgs DNAas DNAas DNAts DNAts DNAgs DNAgs DNAgs OxyGs OxyGs OxyT |
| 16 | 1797 | 1815 | AAGAGGAATTGGGTTTGGG | ASO-0001 | OxyAs OxyAs DNAgs DNAas DNAgs DNAgs DNAas DNAas DNAts DNAts DNAgs DNAgs DNAgs OxyGs OxyGs OxyG |
| 17 | 2299 | 2318 | GAGCACACATTATTAATCAA | ASO-0107 | OxyGs OxyAs OxyGs DNAcs DNAas DNAcs DNAas DNAts DNAts DNAas DNAts DNAts OxyAs OxyTs OxyMCs OxyAs OxyA |
| 18 | 2415 | 2434 | ATTGATTTTAGTGGATTGCC | ASO-0108 | OxyAs OxyTs DNAts DNAgs DNAas DNAts DNAts DNAts DNAts DNAas DNAgs DNAts DNAgs DNAgs OxyAs OxyTs OxyMCs OxyG |
| 19 | 2495 | 2514 | CCTGGAAACCAATAATTAGC | ASO-0109 | OxyMCs OxyMCs DNAts DNAgs DNAgs DNAas DNAas DNAas DNAcs DNAcs DNAas DNAas DNAts DNAts DNAas OxyGs OxyMC |
| 20 | 2496 | 2514 | CCTGGAAACCAATAATTAG | ASO-0110 | OxyMCs OxyMCs DNAts DNAgs DNAgs DNAaas DNAas DNAas DNAcs DNAcs DNAas DNAas DNAts DNAts OxyAs OxyG |
| 21 | 2496 | 2515 | CCCTGGAAACC | ASO- | OxyMCs OxyMCs DNAts DNAgs DNAgs DNAas DNAas DNAas DNAcs DNAcs DNAas DNAas DNAts DNAts DNAas DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 22 | 2497 | 2514 | AATAATTAG CCTGGAAACCA ATAATTA | ASO-0111 | DNAcs DNAaas DNAts DNAas DNAts DNAts OxyAs OxyG |
| | | | | ASO-0112 | OxyMCs OxyMCs OxyTs DNAgs DNAgs DNAaas DNAts DNAcs DNAcs DNAaas DNAts DNAcs OxyTs OxyA |
| 23 | 2497 | 2515 | CCCTGGAAACC AATAATTA | ASO-0113 | OxyMCs OxyMCs DNAcs DNAgs DNAgs DNAaas DNAts DNAcs DNAaas DNAts OxyTs OxyA |
| 24 | 2566 | 2583 | GATAATTTTGG CAGCATA | ASO-0002 | OxyGs OxyAs DNAts DNAaas DNAaas DNAts DNAts DNAts DNAts DNAgs DNAgs OxyTs OxyA |
| 25 | 2566 | 2584 | TGATAATTTTG GCAGCATA | ASO-0003 | DNAcs DNAaas DNAgs OxyMCs OxyAs OxyTs OxyA OxyTs OxyGs OxyAs DNAts DNAaas DNAts DNAts DNAts DNAgs DNAts DNAgs |
| 26 | 2566 | 2585 | TTGATAATTTTG GCAGCATA | ASO-0004 | OxyTs DNAts DNAgs DNAaas DNAgs DNAcs DNAaas DNAts DNAts DNAts DNAts DNAts DNAts DNAgs OxyMCs OxyAs OxyTs OxyA |
| 27 | 2567 | 2584 | TGATAATTTTG GCAGCAT | ASO-0005 | OxyTs OxyGs OxyAs DNAts DNAaas DNAts DNAts DNAts DNAts DNAts DNAts DNAgs OxyMCs OxyAs OxyT |
| 28 | 2568 | 2585 | TTGATAATTTTG GCAGCA | ASO-0006 | OxyTs OxyTs OxyGs OxyAs DNAts DNAaas DNAts DNAts DNAts DNAts DNAts DNAgs OxyMCs OxyA |
| 29 | 2570 | 2586 | GTTGATAATTT GGCAG | ASO-0007 | OxyGs OxyTs DNAts DNAgs DNAaas DNAts DNAaas DNAts DNAts DNAts DNAts OxyAs OxyG |
| 30 | 2571 | 2588 | GTGTTGATAAT TTTGGCA | ASO-0008 | OxyGs OxyTs DNAgs DNAts DNAts DNAgs OxyGs OxyMCs OxyA |
| 31 | 2571 | 2590 | TGGTGTTGATA ATTTTGGCA | ASO-0009 | OxyTs OxyGs DNAgs DNAts DNAts DNAgs DNAts DNAts DNAaas DNAgs OxyMCs OxyA |
| 32 | 2572 | 2590 | TGGTGTTGATA ATTTTGGC | ASO-0010 | OxyTs OxyGs DNAgs DNAgs DNAts DNAts DNAts DNAts DNAgs OxyGs OxyMC |
| 33 | 2572 | 2591 | TTGGTGTTGAT AATTTTGGC | ASO-0011 | OxyTs DNAts DNAaas DNAts DNAgs DNAaas DNAts DNAts DNAts OxyGs OxyGs OxyMC |
| 34 | 2574 | 2592 | TTGGTGTTGA TAATTTTG | ASO-0114 | OxyTs OxyTs OxyTs OxyGs DNAgs DNAts DNAaas DNAgs DNAts DNAts OxyTs OxyTs OxyG |
| 35 | 2575 | 2594 | TTTTGGTGTT GATAATTTT | ASO-0115 | OxyTs OxyTs OxyTs DNAts DNAgs DNAgs DNAaas DNAgs OxyTs OxyTs OxyT |
| 36 | 2576 | 2594 | TTTTGGTGTT GATAATTT | ASO-0116 | OxyTs OxyTs OxyTs DNAts DNAts DNAgs DNAaas OxyAs OxyTs OxyT |
| 37 | 2576 | 2595 | CTTTTTGGTGT TGATAATTT | ASO-0117 | OxyMCs OxyTs OxyTs OxyTs DNAts DNAgs DNAaas DNAts DNAaas OxyAs OxyTs OxyT |
| 38 | 2577 | 2595 | CTTTTTGGTGT TGATAATT | ASO-0118 | OxyMCs OxyTs OxyTs OxyTs DNAts DNAts DNAts DNAts OxyAs OxyAs OxyTs OxyT |
| 39 | 2577 | 2596 | GCTTTTGGTG TTGATAATT | ASO-0119 | OxyGs OxyMCs OxyTs OxyTs DNAts DNAts DNAts DNAgs DNAaas DNAts OxyTs OxyT |
| 40 | 2578 | 2595 | CTTTTTGGTGT | ASO- | OxyMCs OxyTs OxyTs OxyTs DNAts DNAts DNAts DNAgs DNAts DNAgs OxyTs OxyT |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 41 | 2578 | 2596 | TGATAAT | 0120 | DNAts DNAgs DNAas OxyTs OxyAs OxyAs OxyT |
| 42 | 2578 | 2596 | GCTTTTTGGTG TTGATAAT | ASO-0121 | OxyGs OxyMCs OxyTs DNAts DNAts DNAgs DNAgs DNAts DNAts DNAts DNAgs DNAaas OxyAs OxyT |
| 43 | 2579 | 2597 | AGCTTTTTGGT GTTGATAAT | ASO-0122 | OxyAs DNAgs DNAts DNAts DNAgs DNAaas OxyTs OxyAs OxyAs OxyT |
| 44 | 2579 | 2596 | GCTTTTTGGTG TTGATAA | ASO-0123 | DNAgs DNAts DNAts DNAgs DNAgs DNAts DNAts DNAts DNAgs DNAgs DNAts DNAts DNAgs OxyAs OxyTs OxyAs OxyA |
| 45 | 2579 | 2597 | AGCTTTTTGGT GTTGATAA | ASO-0124 | DNAts DNAts DNAts DNAgs DNAgs DNAts DNAts DNAts DNAgs DNAgs OxyMCs DNAts DNAgs DNAts DNAts DNAgs OxyAs OxyA |
| 46 | 2579 | 2598 | AAGCTTTTTGG TGTTGATAA | ASO-0125 | OxyAs OxyAs DNAgs DNAts DNAts DNAgs DNAgs DNAts DNAts DNAts DNAgs DNAgs OxyMCs DNAts DNAgs DNAts DNAgs OxyAs OxyA |
| 47 | 2580 | 2596 | GCTTTTTGGTG TTGATA | ASO-0126 | OxyGs OxyMCs DNAts DNAts DNAts DNAgs DNAgs DNAts DNAts DNAts DNAgs DNAgs OxyMCs DNAts DNAgs OxyAs OxyTs OxyA |
| 48 | 2580 | 2597 | AGCTTTTTGGT GTTGATA | ASO-0127 | OxyAs OxyGs DNAcs DNAts DNAgs DNAgs DNAts DNAts DNAts DNAgs DNAgs OxyAs OxyTs OxyA |
| 49 | 2580 | 2598 | AAGCTTTTTGG TGTTGATA | ASO-0128 | OxyAs DNAaas DNAgs DNAts DNAcs DNAts DNAts DNAts DNAgs DNAgs DNAts DNAts DNAgs OxyGs OxyAs OxyTs OxyA |
| 50 | 2581 | 2597 | AGCTTTTTGGT GTTGAT | ASO-0129 | OxyAs OxyGs OxyMCs DNAts DNAts DNAts DNAgs DNAgs DNAts DNAts DNAts DNAgs DNAts OxyAs OxyT |
| 51 | 2581 | 2598 | AAGCTTTTTGG TGTTGAT | ASO-0130 | OxyAs OxyAs OxyGs OxyMCs DNAts DNAts DNAts DNAgs DNAgs DNAts DNAts DNAts DNAgs OxyAs OxyT |
| 52 | 2582 | 2598 | AAGCTTTTTGG TGTTGA | ASO-0131 | OxyAs OxyAs OxyGs OxyMCs DNAts DNAts DNAgs DNAgs DNAts DNAts DNAts DNAgs OxyGs OxyA |
| 53 | 2607 | 2623 | GTTGAAAATAC CCACCC | ASO-0132 | OxyGs DNAts DNAgs DNAaas OxyMCs OxyMCs OxyMC DNAcs DNAcs DNAaas DNAaas DNAts DNAaas DNAaas |
| 54 | 2851 | 2870 | TTTAAATATAG TTATTCAT | ASO-0133 | OxyTs OxyTs OxyTs DNAaas DNAaas DNAts DNAts DNAts DNAts DNAaas OxyMCs OxyAs OxyT |
| 55 | 3239 | 3256 | TTATGTCAACA GCTATTT | ASO-0134 | OxyTs OxyTs OxyTs DNAgs DNAts DNAts DNAgs DNAts DNAcs DNAaas DNAcs DNAts OxyTs OxyT |
| 56 | 3576 | 3593 | ATTTGCAATAA ATATGGA | ASO-0135 | OxyAs OxyTs OxyTs OxyTs DNAgs DNAts DNAaas DNAaas DNAts DNAaas OxyGs OxyA |
| 57 | 3778 | 3794 | CTGTGGAGTAG AGACTA | ASO-0136 | OxyMCs OxyTs DNAgs DNAaas DNAgs DNAaas OxyMCs OxyTs OxyA |
| 58 | 4221 | 4240 | TAGGTAGTTCT TTGAAGCAG | ASO-0137 | OxyTs DNAts DNAts DNAts DNAgs DNAaas DNAgs DNAts DNAaas DNAts OxyAs OxyG |
| 59 | 4225 | 4241 | GTAGGTAGTTC TTTGAA | ASO-0138 | OxyGs OxyTs DNAgs DNAts DNAts DNAgs DNAgs DNAts DNAaas OxyAs OxyA |
| | 4926 | 4945 | GTAAAATTGAC | ASO- | OxyGs OxyTs OxyAs DNAaas DNAts DNAts DNAgs DNAaas DNAcs DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 60 | 4982 | 4998 | ACAATACTT | ASO-0139 | DNAas DNAcs DNAas DNAts OxyAs OxyMCs OxyTs OxyT |
| 61 | 5256 | 5274 | TGACCATTTTG AAGGAA | ASO-0140 | OxyTs OxyGs OxyAs OxyMCs DNAas DNAcs DNAts DNAts DNAts DNAgs DNAas DNAgs DNAgs OxyAs OxyA |
| 62 | 5798 | 5814 | GATTTATTTTCA GTATTG | ASO-0141 | OxyGs OxyAs OxyTs OxyTs DNAts DNAas DNAcs DNAts DNAts DNAcs DNAas DNAgs DNAts DNAas OxyTs OxyTs OxyG |
| 63 | 6204 | 6221 | TATGGTATGTA TGACTA | ASO-0142 | OxyTs OxyAs OxyTs OxyGs DNAgs DNAts DNAas DNAas DNAts DNAas DNAts DNAgs DNAas OxyMCs OxyTs OxyA |
| 64 | 6209 | 6228 | ACTTTATATAAT TTGACA | ASO-0143 | OxyAs OxyMCs OxyTs OxyTs DNAts DNAas DNAts DNAts DNAts OxyAs OxyMCs OxyA |
| 65 | 6211 | 6228 | TTCTTGGACTT TATATAATT | ASO-0012 | OxyTs OxyTs OxyMCs OxyTs DNAts DNAgs DNAgs DNAas DNAcs DNAts DNAts OxyAs OxyAs OxyT |
| 66 | 6797 | 6813 | TTCTTGGACTT TATATAA | ASO-0144 | OxyTs OxyTs OxyMCs OxyTs DNAts DNAgs DNAgs DNAts DNAas OxyTs OxyAs OxyA |
| 67 | 7148 | 7164 | GTAGCAAGAAT TAGTTT | ASO-0145 | OxyGs OxyTs OxyAs OxyGs DNAas DNAas DNAgs OxyTs OxyTs OxyT |
| 68 | 7248 | 7264 | TTAATATCAAG ACCTAT | ASO-0146 | OxyTs OxyTs OxyAs OxyAs DNAts DNAts DNAts DNAcs DNAas DNAgs OxyAs OxyT |
| 69 | 7738 | 7756 | CTGGAAGTGTG GATATA | ASO-0147 | OxyMCs OxyTs OxyGs OxyGs DNAas DNAts DNAas DNAas OxyTs OxyA |
| 70 | 7987 | 8006 | TGTAACTTAAA ATCTTTAA | ASO-0148 | OxyTs OxyGs OxyTs OxyAs DNAas DNAcs DNAts DNAas DNAas OxyTs OxyAs OxyA |
| 71 | 8068 | 8085 | TAGTACTTTATT CATGCTTG | ASO-0149 | OxyTs DNAas DNAcs DNAts DNAgs DNAas OxyMCs OxyTs OxyTs OxyG |
| 72 | 8560 | 8577 | TTTCTTTAAATC AATACT | ASO-0150 | OxyTs OxyTs OxyTs DNAts DNAts OxyAs OxyMCs OxyT |
| 73 | 8994 | 9012 | AGGAGTTAAAA TGAGACT | ASO-0151 | OxyAs OxyGs OxyAs DNAgs DNAts DNAts DNAts DNAas DNAgs OxyAs OxyMCs OxyT |
| 74 | 9181 | 9199 | AATGGAAGAT AAAATGTA | ASO-0152 | OxyAs OxyAs OxyTs OxyGs DNAgs DNAas DNAas DNAas DNAts DNAgs DNAas DNAts OxyTs OxyA |
| 75 | 9246 | 9263 | AACCATTTTCC TACCATTT | ASO-0153 | OxyAs OxyAs OxyMCs OxyMCs DNAas DNAcs DNAts DNAas DNAts DNAcs DNAts DNAcs DNAas OxyTs OxyA |
| 76 | 9752 | 9768 | TGTATAGTGAG ATATTTT | ASO-0154 | OxyTs OxyTs OxyGs OxyTs DNAts DNAgs DNAts DNAas DNAgs DNAgs DNAas DNAts OxyT |
| 77 | 10016 | 10033 | AAGTAGGGAGA ATGTTC | ASO-0155 | OxyAs OxyAs OxyGs OxyTs DNAas DNAgs DNAgs OxyTs OxyMC |
| 78 | 10465 | 10484 | CTAATATATGA GAAGTAA | ASO-0156 | OxyMCs OxyTs OxyAs OxyAs DNAts DNAas OxyGs OxyAs OxyA |
| | | | TTCATGCTTTAT | ASO- | OxyTs OxyTs OxyMCs OxyAs DNAts DNAcs DNAas OxyGs OxyAs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 79 | 10665 | 10684 | TTCAATGT GAAATTCAAAT TATCCAGAA | 0157 | DNAts DNAts DNAts DNAcs DNAas DNAts DNAcs OxyGs OxyT OxyGs OxyAs OxyAs DNAts DNAts DNAcs DNAas DNAts DNAas DNAts DNAts DNAas DNAts DNAcs DNAas OxyAs OxyGs OxyA |
| 80 | 10856 | 10874 | AGAGTTCAAAT TGGGATGG | ASO-0013 | OxyAs DNAgs DNAas DNAgs DNAgs OxyAs DNAts DNAts DNAas DNAts DNAas DNAts DNAts DNAas DNAts DNAts DNAgs DNAgs OxyAs OxyTs OxyGs OxyG |
| 81 | 10862 | 10881 | AGAAAAGAGAG TTCAAATTG | ASO-0159 | OxyAs OxyGs OxyAs DNAts DNAts DNAcs DNAas DNAgs DNAas DNAas OxyAs OxyTs OxyTs OxyG DNAgs DNAts DNAts DNAcs DNAas DNAas DNAts DNAcs DNAas DNAas DNAts |
| 82 | 11520 | 11539 | TTATTCAAAATA CAACCTCA | ASO-0160 | OxyTs OxyTs OxyAs DNAts DNAts DNAcs DNAas DNAas DNAts DNAcs OxyMCs OxyTs OxyMCs OxyA DNAas DNAcs DNAas DNAas DNAcs DNAas DNAas DNAts |
| 83 | 11881 | 11897 | TATTAATTACTG TGCCA | ASO-0161 | OxyTs OxyAs OxyTs OxyTs DNAas DNAts DNAts DNAas DNAts DNAacs DNAas DNAts DNAgs DNAts DNAgs OxyMCs OxyMCs OxyA |
| 84 | 12135 | 12154 | AGAAAATACTG AATTATACA | ASO-0162 | OxyAs OxyGs OxyAs DNAas DNAas DNAts DNAas OxyTs OxyAs OxyMCs OxyA DNAas DNAas DNAts DNAats DNAts DNAts DNAcs DNAts DNAgs |
| 85 | 12329 | 12346 | GTAGAATGGAT CAAATT | ASO-0163 | OxyGs OxyTs OxyAs OxyGs DNAas DNAas OxyAs OxyTs OxyT DNAcs DNAas DNAas DNAgs DNAas DNAts DNAats DNAts DNAgs DNAas DNAts |
| 86 | 12722 | 12741 | GAATAGGTATT AGAAATATG | ASO-0164 | OxyGs OxyAs OxyAs OxyTs DNAats DNAcs DNAgs DNAas DNAts DNAts DNAats OxyTs OxyAs OxyTs OxyG DNAas DNAgs DNAas DNAas DNAts DNAts |
| 87 | 13070 | 13089 | TATTTTATGATA TGATTATT | ASO-0165 | OxyTs OxyAs OxyAs OxyTs OxyTs DNAts DNAts DNAats DNAts OxyTs OxyAs OxyTs OxyT DNAas DNAas DNAgs DNAgs DNAas DNAts DNAas DNAts |
| 88 | 13270 | 13286 | TTGCAGTACAT AGGGAA | ASO-0166 | OxyTs OxyTs DNAgs DNAcs DNAas DNAgs DNAats OxyGs OxyA DNAas DNAas DNAgs OxyGs OxyGs OxyAs OxyA DNAas DNAts DNAcs DNAas DNAts |
| 89 | 13559 | 13573 | CTCGCATACTT TGTC | ASO-0167 | OxyMCs DNAts DNAcs DNAgs DNAmcs DNAas DNAts DNAats DNAats DNAats DNAts DNAts OxyTs OxyGs OxyTs OxyMC |
| 90 | 13722 | 13740 | TAATTTTACTTG ACTTTAC | ASO-0168 | OxyTs OxyAs OxyAs OxyTs DNAts DNAts DNAts DNAats OxyTs OxyAs OxyMC DNAgs DNAas DNAcs DNAts DNAts DNAts DNAats DNAts DNAts |
| 91 | 14250 | 14266 | TACTTAGTCAC TCTTAA | ASO-0169 | OxyTs OxyAs OxyMCs OxyMCs DNAts DNAts DNAcs DNAas OxyA DNAcs DNAas DNAcs DNAts DNAcs OxyTs OxyTs OxyAs OxyA |
| 92 | 14390 | 14407 | ATCTTAGTTTTG GATTTG | ASO-0170 | OxyAs OxyTs OxyMCs OxyMCs DNAts DNAats DNAgs DNAats DNAts DNAts DNAmcs DNAgs DNAas DNAgs DNAgs DNAgs OxyTs OxyTs OxyG DNAas DNAgs DNAts DNAts DNAts DNAgs DNAats |
| 93 | 14747 | 14766 | ATTTAAATCGA AGTTGTCTT | ASO-0171 | OxyAs OxyTs OxyTs OxyTs DNAas DNAas DNAats DNAmcs DNAgs OxyA DNAas DNAats DNAgs DNAts DNAgs OxyTs OxyMCs OxyTs OxyT DNAas DNAats DNAas DNAts DNAcs DNAgs DNAas |
| 94 | 14764 | 14780 | TAGGGAGGCTA AATATT | ASO-0172 | OxyTs OxyTs OxyGs DNAgs DNAgs DNAgs DNAts OxyTs OxyAs OxyT DNAas DNAas DNAts DNAcs DNAgs DNAgs DNAcs DNAts DNAas DNAas OxyAs OxyA |
| 95 | 15458 | 15475 | TGGACATTATG ATTATCA | ASO-0173 | OxyTs OxyGs OxyGs DNAas DNAcs DNAas DNAts OxyTs OxyMCs OxyA DNAas DNAts DNAas DNAts DNAts DNAts DNAts DNAcs DNAas |
| 96 | 15470 | 15487 | ATTGGGAGATT ATGGACA | ASO-0014 | OxyAs OxyTs OxyTs OxyGs OxyGs DNAgs DNAas DNAgs DNAas DNAts DNAts OxyMCs OxyA DNAas DNAts DNAgs DNAgs DNAgs DNAas DNAts DNAgs DNAas |
| 97 | 15644 | 15663 | TTTGGTTTTGGA | ASO- | OxyTs OxyTs OxyTs DNAgs DNAgs DNAts DNAts DNAts DNAgs DNAgs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 98 | 15669 | 15686 | TTATTTCAA | 0174 | DNAts DNAts DNAts DNAas DNAts DNAts OxyTs OxyMCs OxyAs OxyA |
| 99 | 16298 | 16315 | TGGTATTTCTA AGTTTAG | ASO-0175 | OxyTs OxyGs OxyGs OxyTs DNAas DNAts DNAts DNAcs DNAts DNAas DNAas DNAts DNAts DNAts OxyAs OxyG |
| 100 | 16504 | 16523 | TTCCTCATTAAT AGTAGA | ASO-0176 | OxyTs OxyTs OxyMCs OxyMCs DNAts DNAcs DNAas DNAts DNAts DNAas DNAts DNAts DNAas OxyGs OxyA |
| 101 | 16574 | 16590 | ACTTTCTTCTG ATACTGAAG | ASO-0177 | OxyAs OxyMCs DNAts DNAts DNAts DNAts DNAcs DNAts DNAts DNAts DNAts DNAts DNAts DNAgs OxyAs OxyAs OxyG |
| 102 | 17218 | 17235 | CCTCAATGTTA CCTTTC | ASO-0178 | DNAas DNAts DNAcs DNAcs DNAts DNAts OxyTs OxyTs OxyMC |
| 103 | 17404 | 17419 | ACAGTTTTATA GATAAGA | ASO-0179 | OxyAs OxyMCs OxyAs OxyGs DNAts DNAts DNAts DNAts DNAas DNAts DNAts DNAas DNAts DNAts DNAts DNAas OxyGs OxyA |
| 104 | 17654 | 17671 | TATCCTAAACT AGCCC | ASO-0180 | OxyTs DNAas DNAts DNAcs DNAcs DNAts DNAas DNAas DNAas DNAts DNAas DNAcs DNAts OxyMCs OxyMC |
| 105 | 17708 | 17725 | AATGTGCTAGG TTCTGAG | ASO-0181 | OxyAs OxyAs DNAts DNAgs DNAts DNAgs DNAts DNAas DNAts DNAcs DNAts DNAas DNAgs DNAgs OxyTs OxyGs OxyAs OxyG |
| 106 | 19162 | 19179 | AGTCATTAATT CTTTATC | ASO-0182 | OxyAs OxyGs OxyTs OxyMCs DNAts DNAts DNAts DNAts DNAas DNAts DNAas DNAts OxyTs OxyAs OxyTs OxyMC |
| 107 | 19372 | 19388 | TGTAAGCAAGG CACAAGA | ASO-0183 | OxyTs DNAgs DNAts DNAas DNAts DNAas DNAcs DNAas DNAts DNAas DNAas OxyGs OxyAs OxyA |
| 108 | 19703 | 19720 | ACACCTACCTC AATAAC | ASO-0184 | OxyAs OxyMCs OxyMCs DNAas DNAcs DNAcs DNAas DNAts DNAas DNAts DNAcs DNAts DNAas DNAts DNAcs OxyAs OxyAs OxyMC |
| 109 | 19868 | 19884 | CAATATAAGAC ATGAGAG | ASO-0185 | OxyMCs OxyAs OxyAs OxyTs DNAas DNAts DNAas DNAas DNAgs DNAas OxyGs OxyAs OxyG |
| 110 | 20246 | 20263 | CTTATCTATCC AAATGC | ASO-0186 | OxyMCs OxyTs OxyTs OxyAs DNAts DNAcs DNAts DNAts DNAcs DNAts DNAas DNAas DNAas OxyTs OxyGs OxyMC |
| 111 | 20497 | 20515 | ATCCTATCACA TTACTTC | ASO-0187 | OxyAs OxyTs DNAts DNAts DNAts DNAas DNAcs DNAas DNAcs DNAas OxyTs OxyTs OxyMC |
| 112 | 21423 | 21441 | TGTTCTATTTTA TTAGTAC | ASO-0188 | OxyTs OxyGs OxyTs OxyTs OxyMCs DNAts DNAas DNAts DNAts DNAts DNAts DNAas DNAts DNAts DNAts DNAts DNAts DNAts DNAas DNAcs OxyGs OxyTs OxyAs OxyMC |
| 113 | 21444 | 21461 | GAGAGGTAAGA ATGATGAA | ASO-0015 | OxyGs OxyAs OxyGs OxyAs DNAgs DNAas DNAts DNAts DNAas DNAas DNAts DNAgs OxyAs OxyGs OxyAs OxyA |
| 114 | 21808 | 21826 | CTGGGTTTGAG GGAGAGG | ASO-0189 | OxyMCs DNAts DNAgs DNAgs DNAgs DNAts DNAts DNAts DNAgs DNAas DNAas OxyGs OxyG |
| 115 | 22289 | 22308 | TCCTTTGTATTT CTTGAAT | ASO-0190 | OxyTs OxyMCs OxyMCs DNAts DNAts DNAts DNAts DNAts DNAgs DNAts DNAas DNAts DNAts DNAts DNAts DNAts OxyT |
| 116 | 22294 | 22310 | ATAGGTTGATG TTTCTTTGA | ASO-0191 | OxyAs OxyTs OxyAs DNAgs DNAgs DNAts DNAts DNAgs DNAas DNAts DNAgs DNAts DNAts DNAts DNAts DNAts OxyGs OxyA |
| | | 22310 | TAATAGGTTGA | ASO- | OxyTs OxyAs OxyAs OxyTs DNAas DNAgs DNAgs DNAts DNAts DNAgs DNAas DNAgs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 117 | 22342 | 22358 | TGTTTC | 0192 | DNAts DNAgs OxyTs OxyTs OxyMC |
| 118 | 22992 | 23011 | GCCAAATTCTT TCTAGT | ASO-0193 | OxyGs OxyMCs DNAas DNAts DNAas DNAts DNAts DNAcs DNAts DNAts DNAts DNAcs DNAts DNAas OxyGs OxyT |
| 119 | 23373 | 23392 | AAAATAAATAA CACATCCCA | ASO-0194 | OxyAs OxyAs OxyAs DNAts DNAas DNAts DNAas DNAts DNAas DNAas DNAts DNAas DNAcs DNAas DNAts DNAas OxyMCs OxyMCs OxyA |
| 120 | 23595 | 23614 | TTTTAATGTGTT ATTATCCT | ASO-0195 | OxyTs OxyTs DNAts DNAts DNAts DNAas DNAts DNAts DNAas OxyTs OxyMCs OxyMCs OxyT |
| 121 | 23727 | 23744 | GACCTAAATAT TATACAAGA | ASO-0196 | DNAts DNAts DNAts DNAts DNAts DNAas DNAts DNAas DNAcs OxyAs OxyAs OxyGs OxyA |
| 122 | 24150 | 24166 | TGAAGAATCTA AATATGT | ASO-0197 | OxyTs OxyGs OxyAs OxyAs DNAgs DNAas DNAts DNAas DNAts DNAas DNAts DNAts DNAas DNAts DNAas OxyAs OxyTs OxyGs OxyT |
| 123 | 24404 | 24423 | ATCATCTGGTT GTGAAT | ASO-0198 | OxyAs OxyTs OxyMCs OxyAs DNAts DNAcs DNAts DNAgs DNAgs DNAas OxyAs OxyT |
| 124 | 24407 | 24424 | CTTAATGAATAT AGAGTTCT | ASO-0016 | OxyMCs OxyTs OxyTs OxyAs DNAts DNAgs DNAas DNAts DNAas DNAgs OxyTs OxyTs OxyMCs OxyT |
| 125 | 24747 | 24764 | ACTTAATGAAT ATAGAGT | ASO-0199 | OxyAs OxyMCs OxyTs OxyTs DNAas DNAts DNAas OxyGs OxyAs OxyGs OxyT |
| 126 | 24874 | 24891 | TTAATAATCATA TATACC | ASO-0200 | OxyTs OxyTs OxyAs OxyAs DNAts DNAas DNAts DNAcs DNAas DNAts DNAas OxyMCs OxyMC |
| 127 | 26041 | 26060 | CATAATAATAG TATTTGG | ASO-0201 | OxyMCs OxyAs OxyTs OxyAs DNAas DNAts DNAas DNAts OxyTs OxyTs OxyGs OxyG |
| 128 | 26381 | 26397 | AATAAGAATTT CCATAACTT | ASO-0202 | OxyAs OxyAs OxyTs DNAas DNAas OxyGs OxyTs DNAas DNAas DNAts DNAas OxyMCs OxyMCs OxyT |
| 129 | 27197 | 27215 | GAGAGTAATAA AGTATA | ASO-0203 | OxyGs OxyGs OxyAs OxyAs DNAts DNAgs DNAas OxyAs OxyTs OxyA |
| 130 | 27363 | 27380 | ATTTGAAAGGC TGATGGGA | ASO-0204 | OxyAs DNAts DNAts DNAts DNAgs DNAas DNAas DNAgs OxyGs OxyGs OxyA |
| 131 | 27712 | 27731 | ATGTAATCAA ATAGTTC | ASO-0205 | OxyAs OxyTs OxyTs DNAas OxyGs OxyTs OxyTs OxyMC |
| 132 | 28063 | 28080 | GAAGAGTAATT TAAAAGCTT | ASO-0206 | OxyGs OxyGs OxyAs DNAas DNAts DNAas DNAas OxyMCs OxyTs OxyT |
| 133 | 28249 | 28265 | TTGACATCTGA CTTTAA | ASO-0207 | OxyTs OxyTs OxyGs DNAcs DNAts DNAas DNAts OxyTs DNAas OxyAs OxyAs OxyA |
| 134 | 28369 | 28385 | AGATATAGTTA CTTAAC | ASO-0208 | OxyAs OxyAs OxyGs OxyTs OxyTs OxyAs OxyAs OxyMC |
| 135 | 28782 | 28801 | GTCAAGTTATC AGGTAT | ASO-0209 | OxyGs OxyTs OxyMCs OxyAs DNAgs DNAts DNAas DNAts DNAts DNAts |
| | | | GACAGAGACTG | ASO- | OxyGs OxyAs OxyMCs OxyAs DNAgs DNAas OxyAs DNAgs DNAas DNAas DNAcs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 136 | 28857 | 28873 | AAATGATAA | 0017 | DNAgs DNAas DNAas DNAts DNAgs OxyAs OxyTs OxyAs OxyA |
| 137 | 28897 | 28915 | CTGGAGAAGTT TTGAAG | ASO-0210 | OxyMCs OxyTs OxyGs DNAas DNAgs DNAas DNAgs DNAts DNAts DNAts DNAgs OxyAs OxyG |
| 138 | 29430 | 29446 | TAAAAGAGTTT GCATAGGA | ASO-0211 | OxyTs OxyAs OxyAs DNAas DNAgs DNAas DNAts DNAts DNAts DNAgs DNAcs DNAts DNAgs OxyGs OxyA |
| 139 | 30003 | 30020 | AATATTATTGGT TGAGC | ASO-0212 | OxyAs OxyTs OxyAs DNAts DNAts DNAts DNAts DNAts DNAgs DNAgs DNAts DNAts OxyGs OxyMC |
| 140 | 30007 | 30024 | TCTCATAAACTT CATTCC | ASO-0213 | OxyTs OxyMCs DNAts DNAas DNAts DNAas DNAts OxyTs OxyMCs DNAas DNAcs |
| 141 | 30420 | 30439 | CCTCTCTCATA AACTTCA | ASO-0214 | OxyMCs DNAts DNAas DNAts DNAcs DNAts OxyTs OxyTs OxyMCs OxyA |
| 142 | 30634 | 30653 | ACATTATCTTCA TTAAACAA | ASO-0215 | OxyAs OxyMCs OxyAs OxyTs DNAts DNAas DNAts DNAts DNAcs DNAts DNAts DNAas OxyA |
| 143 | 30870 | 30888 | ATAACTCTGTG TATTAGCAT | ASO-0216 | OxyAs DNAts DNAas DNAts DNAas DNAts DNAas DNAts DNAts DNAgs DNAas OxyGs OxyAs OxyT |
| 144 | 31207 | 31225 | CAGATTTTATT GTCATTC | ASO-0217 | OxyMCs OxyAs OxyGs DNAts DNAcs DNAas OxyAs OxyTs OxyTs OxyMC |
| 145 | 31565 | 31582 | AGAAAAGAATG AAACTGTT | ASO-0218 | OxyAs OxyGs OxyAs OxyAs DNAas DNAgs DNAas DNAas DNAts DNAcs DNAas DNAts |
| 146 | 31711 | 31728 | TGAATTAAAAT GAGAGTA | ASO-0219 | OxyTs OxyGs OxyAs OxyAs DNAts DNAts DNAas DNAts DNAas DNAas DNAts OxyTs OxyT |
| 147 | 32776 | 32793 | TAACTTTTCAG ATGGCAT | ASO-0220 | OxyTs OxyAs OxyAs OxyMCs DNAgs DNAgs OxyMCs OxyAs OxyT |
| 148 | 33003 | 33022 | TAAGTCATCAT CATCGTC | ASO-0221 | OxyTs OxyAs OxyAs OxyGs DNAts DNAcs DNAas DNAmcs DNAgs OxyTs OxyMC |
| 149 | 33008 | 33024 | AAAGAACAGTC CTAATACAA | ASO-0222 | OxyAs OxyAs OxyAs OxyGs DNAas DNAas DNAcs DNAts DNAas DNAas OxyAs OxyA |
| 150 | 33577 | 33596 | CCAAAGAACAG TCCTAA | ASO-0223 | OxyMCs OxyMCs OxyAs DNAas DNAas DNAts DNAts DNAts DNAts DNAcs DNAas DNAas |
| 151 | 33580 | 33598 | ATAAGTAACAA CACAGATGA | ASO-0224 | OxyAs OxyTs OxyAs DNAas DNAas DNAts DNAts DNAas DNAts DNAcs DNAas DNAas OxyAs OxyA |
| 152 | 34058 | 34077 | CAATAAGTAAC AACACAGA | ASO-0018 | OxyMCs OxyAs OxyAs OxyTs DNAas DNAas DNAas DNAas OxyAs OxyGs OxyA |
| 153 | 34060 | 34077 | GCAAAGTCTT AAATACTTC | ASO-0225 | OxyGs OxyMCs OxyAs OxyAs DNAas DNAts DNAts DNAts DNAts OxyTs OxyTs OxyMC |
| 154 | 34238 | 34256 | GCAAAGTCTT AAATACT | ASO-0226 | OxyGs OxyMCs OxyAs OxyAs DNAas DNAts DNAts DNAgs DNAts DNAts DNAts |
| | | | ATCAATATTAAA | ASO- | OxyAs OxyTs OxyMCs OxyAs DNAas DNAts DNAts OxyAs OxyMCs OxyT |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 155 | 34716 | 34732 | TATTTCT | 0227 | DNAas DNAas DNAts DNAts DNAts OxyTs OxyTs OxyMCs OxyT |
| 156 | 35091 | 35110 | ATCAGGACAGG TTATTT | ASO-0228 | OxyAs OxyTs OxyMCs OxyAs DNAgs DNAas DNAcs DNAas DNAgs DNAgs DNAts DNAas OxyTs OxyTs OxyT |
| 157 | 35150 | 35166 | TATATTACTAGT CAAAGGGC | ASO-0229 | OxyTs OxyAs OxyTs DNAts DNAas DNAas DNAgs DNAgs OxyGs OxyMC DNAts DNAcs DNAas DNAas DNAgs DNAas DNAgs DNAgs DNAts DNAas |
| 158 | 35743 | 35762 | CTTATTAGGTA ATTGAA | ASO-0230 | OxyMCs OxyTs OxyTs OxyAs DNAts DNAts OxyGs OxyAs OxyA DNAas DNAts DNAts OxyTs OxyGs OxyAs OxyA |
| 159 | 35839 | 35856 | TACATATTATAT TACTCCTC | ASO-0231 | OxyTs OxyAs OxyMCs DNAas DNAas DNAts DNAas DNAts DNAts OxyMC DNAts DNAts DNAas DNAcs OxyMCs OxyTs OxyMC |
| 160 | 36133 | 36149 | ATTTAAGTTTAT TGAGAT | ASO-0232 | OxyAs OxyTs OxyTs DNAas DNAas DNAts DNAts DNAts DNAas DNAts DNAts DNAas OxyAs OxyGs OxyAs OxyT |
| 161 | 37100 | 37119 | AATAGTTTCAA GTCCAG | ASO-0233 | OxyAs OxyAs OxyTs DNAas DNAgs DNAts DNAts DNAts DNAts DNAcs DNAas DNAas DNAts OxyMCs OxyMCs OxyAs OxyG |
| 162 | 37299 | 37317 | ATTTAGCACAT ACATTAAC | ASO-0234 | OxyAs OxyTs OxyTs OxyTs DNAas DNAas DNAgs DNAts DNAts OxyTs OxyAs OxyAs OxyMC |
| 163 | 37666 | 37683 | CCTTTGGTTAT TTGTTTAT | ASO-0235 | OxyMCs OxyMCs DNAts DNAgs DNAts DNAts DNAas DNAgs DNAts DNAts OxyTs OxyAs OxyT |
| 164 | 37987 | 38006 | GTTAATTATTTG TTATTG | ASO-0236 | OxyGs OxyTs OxyTs OxyAs DNAas DNAts DNAts DNAts DNAas DNAts DNAts DNAts OxyTs OxyTs OxyG |
| 165 | 38072 | 38090 | ATAAATTTTATT AATTGCCT | ASO-0237 | OxyAs OxyTs OxyAs DNAas DNAas DNAts DNAts DNAts OxyGs OxyMCs OxyMCs OxyT |
| 166 | 38079 | 38095 | TTTACAGGATT GTTATCAA | ASO-0019 | OxyTs OxyTs OxyTs OxyAs DNAcs DNAas DNAgs DNAgs OxyTs OxyMCs OxyAs OxyA |
| 167 | 38833 | 38851 | CTAAATTTACA GGATTG | ASO-0238 | OxyMCs OxyTs OxyAs OxyAs DNAas DNAts DNAts DNAts DNAts DNAts DNAcs DNAas DNAts OxyTs OxyTs OxyG |
| 168 | 38835 | 38854 | TTTTGAGGATT AAGAGAA | ASO-0239 | OxyTs OxyTs OxyTs OxyTs DNAgs DNAas DNAgs DNAgs DNAas OxyAs DNAgs OxyAs OxyA |
| 169 | 39616 | 39635 | TTGTTTTGAGG ATTAAAGAG | ASO-0240 | OxyTs OxyTs OxyGs OxyTs DNAts DNAts DNAts DNAgs DNAgs DNAas OxyGs OxyAs OxyG |
| 170 | 39622 | 39640 | ATTGCTTAAATT GACCTCTA | ASO-0241 | OxyAs OxyTs OxyTs DNAgs DNAcs DNAts DNAts DNAts DNAts OxyMCs OxyTs OxyA |
| 171 | 40300 | 40319 | ATTAAATTGCTT AAATTGA | ASO-0242 | OxyAs OxyTs OxyTs OxyAs DNAas DNAts DNAts DNAts DNAts OxyTs OxyGs OxyA |
| 172 | 40317 | 40333 | TTTATTTTAAGC TGAAGACA | ASO-0243 | OxyTs OxyTs OxyTs OxyAs DNAgs DNAas DNAts DNAts DNAas OxyAs OxyMCs OxyA |
| 173 | 40624 | 40643 | TGGTTGGTATA AATTTT | ASO-0244 | OxyTs OxyGs OxyGs OxyTs DNAgs DNAgs DNAts DNAas OxyGs OxyAs OxyMCs DNAts DNAts DNAas DNAts DNAts OxyT |
|  |  |  | GTGATATTCAA | ASO- | OxyGs OxyTs DNAgs DNAas DNAts DNAts DNAts DNAas DNAts DNAcs DNAas DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 174 | 40947 | 40963 | GAAATAGCAAATTGG | 0245 | DNAgs DNAas DNAas DNAts DNAT OxyAs DNAas OxyGs OxyMCs OxyA |
| 175 | 40998 | 41017 | TGTTTAAGATGTAATTGG | ASO-0246 | OxyTs OxyGs OxyTs DNAts DNAas OxyTs DNAgs DNAas DNAgs DNAts DNAas DNAts OxyTs OxyGs OxyG |
| | | | AACATATTAAGTACAAGTGA | 0020 | OxyAs OxyAs OxyMCs OxyAs DNAts DNAas DNAts DNAas DNAts DNAas OxyTs OxyGs OxyA |
| 176 | 40999 | 41016 | ACATATTAAGTACAAGTG | ASO-0247 | OxyAs OxyMCs OxyAs DNAcs DNAas OxyT DNAas DNAts DNAts DNAas DNAas DNAgs DNAts DNAas DNAts DNAas OxyGs OxyTs OxyG |
| 177 | 41740 | 41757 | ACAAATCATTAGTCTATT | ASO-0248 | OxyAs OxyMCs OxyAs OxyAs DNAas DNAts DNAcs DNAts DNAas DNAts DNAas DNAgs DNAts DNAcs DNAts OxyAs OxyT OxyT |
| 178 | 41742 | 41758 | CACAAATCATTAGTCTA | ASO-0249 | OxyMCs OxyAs OxyMCs OxyAs DNAas DNAas DNAts DNAas DNAts DNAcs DNAts DNAas DNAts OxyTs OxyMCs OxyTs OxyA |
| 179 | 42527 | 42546 | CATATTATGCTGTTTCCTG | ASO-0250 | OxyMCs OxyAs DNAts DNAas DNAts DNAts DNAas DNAts DNAgs DNAcs DNAts DNAcs DNAcs OxyTs OxyG |
| 180 | 42531 | 42548 | TTCATATTATGCTGTTTT | ASO-0251 | OxyTs OxyTs OxyMCs OxyAs DNAts DNAas DNAts DNAts DNAas DNAts DNAgs DNAcs DNAts DNAgs DNAts OxyTs OxyT |
| 181 | 42952 | 42969 | CAGTGAAAATCTAAATTA | ASO-0252 | OxyMCs OxyAs OxyGs OxyTs DNAgs DNAas DNAas DNAas DNAts DNAas DNAas OxyAs OxyTs OxyA |
| 182 | 43391 | 43408 | AATTTGGGAAGGTTTAGA | ASO-0253 | OxyAs OxyAs OxyTs OxyTs DNAts DNAgs DNAgs DNAas DNAas DNAgs DNAgs DNAgs DNAgs OxyAs OxyGs OxyA |
| 183 | 43393 | 43410 | GCAATTTGGGAAGGTTTA | ASO-0254 | OxyGs OxyMCs DNAas DNAas DNAts DNAts DNAgs DNAgs DNAgs OxyTs OxyTs OxyTs OxyA |
| 184 | 43931 | 43949 | AGGAGAAGACTTAAATTTT | ASO-0255 | OxyAs OxyGs OxyGs OxyAs DNAgs DNAas DNAas DNAgs DNAas DNAcs DNAts DNAts DNAas DNAas OxyTs OxyT |
| 185 | 44247 | 44264 | GTGGAGAGAGTTGAATTT | ASO-0256 | OxyGs OxyTs OxyGs DNAgs DNAas DNAgs DNAas DNAgs DNAts DNAgs DNAas DNAas OxyTs OxyTs OxyT |
| 186 | 44345 | 44361 | AAAGTGAGTGTTAAGGT | ASO-0257 | OxyAs OxyAs OxyAs OxyGs DNAts DNAgs DNAas DNAgs DNAts DNAgs DNAts DNAas DNAas DNAts DNAgs OxyGs OxyT |
| 187 | 44714 | 44731 | ATTTTAATTTGTGAGTAG | ASO-0258 | OxyAs OxyTs OxyTs DNAts DNAas DNAas DNAts DNAts DNAts DNAgs DNAts DNAts DNAts DNAgs OxyGs OxyG |
| 188 | 44982 | 45001 | AAATTGAACAAGTGAATAGT | ASO-0259 | OxyAs OxyAs OxyAs OxyTs DNAts DNAgs DNAas DNAas DNAcs DNAas DNAas DNAgs DNAts DNAgs DNAas DNAas OxyGs OxyT |
| 189 | 45144 | 45160 | AGTGAACTTAGTGATAT | ASO-0260 | OxyAs OxyGs OxyTs OxyGs DNAas DNAas DNAcs DNAts DNAts DNAas DNAts DNAts DNAas DNAas OxyAs OxyT |
| 190 | 46568 | 46586 | TGTTTCTAGGTTTCATTTT | ASO-0261 | OxyTs OxyGs OxyTs DNAts DNAts DNAcs DNAts DNAas DNAts DNAas DNAgs DNAgs DNAts DNAts DNAts OxyTs OxyT |
| 191 | 46816 | 46835 | TACTTTACATTCTTTTATGT | ASO-0262 | OxyTs OxyAs OxyMCs OxyTs DNAts DNAts DNAts DNAas DNAcs DNAas DNAts DNAts DNAcs DNAts DNAts DNAts DNAas OxyTs OxyGs OxyT |
| 192 | 46826 | 46845 | TCTTCTCAATTA | ASO- | OxyTs OxyTs OxyMCs DNAts DNAts DNAcs DNAts DNAcs DNAas DNAas DNAts DNAts DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 193 | 47165 | 47183 | CTTTACAT | 0021 | DNAas DNAcs DNAts DNAas DNAts OxyAs DNAts OxyMCs OxyAs OxyT |
| 194 | 47167 | 47183 | CTAGTCATTTCTTTGGGTC | ASO-0263 | OxyMCs DNAts DNAas DNAgs DNAts DNAas DNAts DNAts DNAts OxyMC |
| 195 | 47770 | 47788 | CTAGTCATTTCTTTGGG | ASO-0264 | OxyMCs DNAts DNAas DNAts DNAts DNAts DNAts DNAts DNAts DNAts |
| 196 | 47915 | 47931 | TAATTATCATGTATTCAG | ASO-0265 | OxyTs OxyAs OxyAs OxyTs DNAts DNAts DNAts DNAcs DNAts DNAts |
| 197 | 48166 | 48183 | CATTACCACTATATCAT | ASO-0266 | DNAgs DNAts DNAas DNAts OxyTs OxyMCs OxyAs OxyG |
| 198 | 48838 | 48855 | TTTTCTTATCAATATGCA | ASO-0267 | DNAas DNAts DNAas OxyTs OxyTs DNAas DNAcs DNAts OxyAs OxyT |
| 199 | 49269 | 49286 | TGAATAATGTTTACTAA | ASO-0268 | OxyTs OxyTs DNAts DNAcs DNAts DNAas DNAts DNAcs DNAts DNAas |
| 200 | 49272 | 49289 | ATCTGTGAATACTTTGAA | ASO-0269 | OxyTs OxyGs OxyAs OxyAs DNAts DNAas DNAts DNAgs DNAts DNAts |
| 201 | 50015 | 50034 | GAAATCTGTGAATACTTT | ASO-0270 | OxyAs OxyMCs DNAts DNAts DNAts OxyTs OxyGs OxyAs OxyA |
| 202 | 50024 | 50041 | TATACTTGTTCTCTCACTTT | ASO-0271 | OxyGs OxyAs OxyAs DNAts DNAas OxyMCs DNAts OxyTs OxyT |
| 203 | 50265 | 50283 | CATTAAATATACTTGTTC | ASO-0272 | OxyTs OxyAs DNAts DNAcs DNAts DNAas DNAcs OxyTs OxyTs OxyT |
| 204 | 50610 | 50628 | ATGAAAATAAATGATCTAG | ASO-0273 | OxyMCs DNAts DNAas OxyTs OxyTs DNAas DNAas DNAts DNAts DNAts |
| 205 | 50889 | 50907 | TCATTCTTAAAATACTAAC | ASO-0274 | OxyAs OxyMCs OxyAs OxyTs DNAts DNAcs DNAts DNAts DNAts DNAts DNAas |
| 206 | 51319 | 51337 | CTTGTTTAAATTCTAATA | ASO-0275 | OxyTs OxyMCs OxyAs OxyTs OxyGs DNAts DNAcs DNAts DNAts DNAts DNAts DNAas |
| 207 | 51570 | 51588 | TGATATAGCAAAGCAATGT | ASO-0276 | OxyTs OxyGs OxyAs DNAas DNAcs DNAas OxyAs OxyTs OxyGs OxyT |
| 208 | 51576 | 51594 | TTATGACTGGAAGAACAAA | ASO-0277 | OxyTs OxyTs OxyTs DNAas DNAgs DNAas OxyMCs OxyAs OxyA |
| 209 | 51789 | 51807 | TGTTTATTATGACTGGAAG | 0022 | OxyTs OxyGs OxyTs DNAts DNAgs OxyGs OxyAs OxyG |
| 210 | 51976 | 51993 | ATTTTGACAAGACTTACAT | ASO-0278 | OxyAs OxyTs OxyTs OxyTs DNAts DNAts DNAcs DNAts OxyAs OxyT |
| 211 | 52383 | 52401 | TGCACTTTTATCTTTAAC | ASO-0279 | OxyTs OxyGs OxyMCs DNAts DNAts DNAts DNAts DNAts DNAts OxyMC |
|   |   |   | ATGATTTAAATA | ASO- | OxyAs OxyTs OxyGs DNAts DNAts DNAts DNAas DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 212 | 52840 | 52859 | TTTTGGG | 0280 | DNAas DNAts DNAts OxyTs OxyGs OxyGs OxyG |
| 213 | 52861 | 52879 | TGAAATTTTAA GGACAGAAA | ASO-0281 | OxyTs OxyGs OxyAs OxyAs DNAas DNAts DNAts DNAts DNAas DNAts DNAgs DNAas DNAcs DNAas OxyGs OxyAs OxyAs OxyA |
| 214 | 53490 | 53507 | TTTAATGGAAC TAAACTAT | ASO-0282 | OxyTs OxyTs OxyTs OxyAs DNAas DNAts DNAgs DNAgs DNAas DNAas OxyTs OxyAs OxyT DNAts DNAas DNAas OxyMCs OxyTs OxyAs OxyT |
| 215 | 53682 | 53698 | AAATGAACGAG GAACTGG | ASO-0283 | OxyAs OxyAs OxyAs DNAts DNAgs DNAas DNAas DNAmcs DNAgs DNAas DNAgs DNAas DNAas OxyMCs OxyTs OxyGs OxyG |
| 216 | 54402 | 54421 | TGTTACTAGTC ATCATG | ASO-0284 | OxyTs OxyGs OxyTs DNAts DNAas DNAas DNAcs DNAts DNAas DNAgs DNAts DNAas DNAts OxyMCs OxyAs OxyTs OxyG |
| 217 | 54418 | 54434 | AGGAAAATTGT GGAATCTTT | ASO-0285 | OxyAs OxyGs DNAgs DNAas DNAas DNAas DNAts DNAas DNAgs DNAts DNAgs DNAts OxyMCs OxyTs OxyTs OxyT |
| 218 | 54752 | 54770 | ATTTGGGTTAC TAAGGA | ASO-0286 | OxyAs OxyTs OxyTs DNAgs DNAgs DNAts DNAts DNAts DNAas DNAcs DNAts OxyGs OxyA |
| 219 | 54932 | 54950 | AATAGAAAATT AGTTTAGA | ASO-0287 | OxyAs OxyAs OxyTs OxyAs DNAgs DNAas DNAas DNAas DNAts OxyTs OxyAs OxyGs OxyA DNAas DNAas DNAgs DNAts DNAts OxyTs OxyAs OxyGs OxyA |
| 220 | 55303 | 55319 | TTGCAAAATAA TATGTTCT | ASO-0288 | OxyTs OxyTs OxyGs OxyMCs DNAas DNAas DNAas DNAas DNAts OxyTs OxyTs OxyMCs OxyT DNAas DNAts DNAas DNAts DNAgs DNAas OxyTs OxyMCs OxyT |
| 221 | 55457 | 55473 | TAAGGATGGT ATGGCT | ASO-0289 | OxyTs OxyAs DNAas DNAgs DNAgs DNAas DNAts DNAgs DNAgs DNAts OxyGs OxyGs OxyMCs OxyT |
| 222 | 55843 | 55862 | TGGAGTAACAA AATGAG | ASO-0290 | OxyTs OxyGs OxyGs OxyAs DNAgs DNAas DNAts DNAas DNAas DNAas DNAas DNAas DNAas OxyGs OxyAs OxyG |
| 223 | 55912 | 55929 | GTTAAGAAATT TTGAAGTGC | ASO-0023 | OxyGs OxyTs OxyTs OxyAs DNAas DNAgs DNAas DNAas DNAas DNAts DNAts OxyTs OxyGs OxyAs OxyMC DNAts DNAts DNAgs DNAas DNAas OxyGs OxyTs OxyGs OxyMC |
| 224 | 56166 | 56184 | AGATCAAGGCT AAAGAGA | ASO-0291 | OxyAs OxyGs DNAas DNAts DNAcs DNAas DNAas DNAgs DNAgs DNAcs DNAts DNAas DNAas DNAas OxyGs OxyAs OxyA |
| 227 | 56918 | 56935 | TTGATAGTGAA TGAAATTT | ASO-0292 | OxyTs OxyTs OxyGs OxyAs DNAts DNAas DNAgs DNAts DNAgs DNAas DNAas OxyAs OxyTs OxyT DNAts DNAgs DNAas DNAas OxyAs OxyTs OxyT |
| 228 | 57034 | 57051 | TATATTTAATCA GATATC | ASO-0297 | OxyTs OxyAs OxyAs OxyTs DNAts DNAts DNAts DNAas DNAas DNAts DNAas OxyAs OxyTs OxyMC DNAas DNAas DNAas OxyTs OxyAs OxyTs OxyMC |
| 229 | 57343 | 57361 | TGCCTGAATAA AGTAAGA | ASO-0298 | OxyTs OxyGs OxyMCs OxyMCs DNAts DNAas DNAcs DNAas DNAgs OxyA DNAas DNAas DNAts DNAas DNAas OxyGs OxyA |
| 230 | 57600 | 57617 | TAATTTACTTGA CATTTC | ASO-0299 | OxyTs OxyAs OxyTs OxyTs DNAts DNAts DNAts DNAas OxyMC DNAas DNAts DNAts OxyTs OxyTs DNAts DNAts OxyTs OxyTs OxyMC |
| 231 | 57859 | 57876 | ATTATTATAAGC TATTTG | ASO-0300 | OxyAs OxyTs OxyTs DNAts DNAts DNAts DNAgs DNAas DNAas DNAts DNAas DNAts DNAcs DNAts DNAts DNAts OxyTs OxyG |
| 232 | 58265 | 58282 | TAATTGATATAA AGTAGC | ASO-0301 | OxyTs OxyGs OxyAs OxyAs DNAgs OxyTs DNAts DNAas DNAas DNAcs DNAas DNAts DNAts DNAts DNAgs DNAts DNAts DNAts OxyGs OxyAs OxyGs OxyMC |
| | | | AAGAACTTCTT | ASO- | OxyAs OxyAs DNAas DNAts DNAcs DNAas DNAas DNAts DNAts DNAas DNAts DNAts DNAts OxyGs OxyAs OxyGs OxyMC OxyAs DNAas DNAts DNAts DNAts OxyAs OxyGs OxyTs OxyGs OxyAs OxyMC |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 233 | 58617 | 58633 | AAAATAGGTTAGGTCTG | ASO-0302 | DNAcs DNAas DNAts DNAts OxyGs OxyMCs OxyA |
| 234 | 58780 | 58796 | GTTGAGAATACAGATTG | ASO-0303 | OxyAs OxyAs OxyAs OxyAs DNAts DNAas DNAgs DNAgs DNAts DNAas DNAgs DNAgs OxyTs OxyMCs OxyTs OxyG |
| 235 | 58919 | 58937 | AGACACATTTCATTTAAG | ASO-0304 | OxyGs OxyTs OxyTs OxyGs DNAas DNAgs DNAas DNAas DNAts DNAas DNAts OxyTs OxyG |
| 236 | 59562 | 59581 | TTTATTTACAATCCTTTAAA | ASO-0305 | OxyAs OxyGs OxyAs OxyMCs DNAcs DNAas DNAts DNAts DNAas DNAts OxyAs OxyG |
| 237 | 59636 | 59654 | TTTATATTAAGGACCAGAC | ASO-0306 | OxyTs OxyTs OxyTs OxyAs DNAts DNAts DNAts DNAcs DNAas DNAts OxyTs OxyAs OxyAs OxyA |
| 238 | 59638 | 59655 | TTTTATATTAAGGACCAG | ASO-0024 | OxyTs OxyTs OxyTs OxyAs DNAts DNAts DNAcs DNAas DNAcs OxyAs OxyGs OxyAs OxyMC |
| 239 | 61917 | 61935 | TGTCTATAATATCTCCATC | ASO-0307 | OxyTs OxyTs OxyTs DNAas DNAas OxyMCs OxyMCs OxyAs OxyG |
| 240 | 62140 | 62158 | CATTATGATATAAACATGT | ASO-0308 | OxyTs DNAgs DNAts DNAcs DNAts DNAcs OxyMCs OxyAs OxyTs OxyMC |
| 241 | 62487 | 62506 | TAATCTAAGGTTTACTAAGA | ASO-0309 | OxyMCs OxyAs OxyTs OxyTs DNAas DNAts DNAgs DNAas DNAts DNAas OxyTs OxyGs OxyT |
| 242 | 62667 | 62683 | ATGGCTACTTTGGTTTT | ASO-0310 | OxyTs OxyAs OxyAs OxyTs DNAcs DNAas DNAts DNAcs DNAas OxyAs OxyGs OxyA |
| 243 | 62877 | 62894 | ATTGCCTAGAAGAAATGA | ASO-0311 | OxyAs OxyTs OxyGs DNAgs DNAts DNAts DNAgs DNAcs DNAts OxyTs OxyT |
| 244 | 63189 | 63205 | TTTGTGATAGGTATATG | ASO-0312 | OxyAs OxyAs DNAgs DNAas DNAas OxyTs OxyGs OxyA |
| 245 | 63479 | 63496 | GTTTCTGTGATAATTTAA | ASO-0313 | OxyTs OxyTs OxyTs OxyGs DNAas DNAgs DNAas OxyTs OxyG |
| 246 | 63973 | 63991 | TATAAATGGCAGTACAGAT | ASO-0314 | OxyMCs OxyAs DNAts DNAts DNAts OxyTs OxyAs OxyA |
| 247 | 63976 | 63994 | ATTTATAAATGGCAGTACA | ASO-0315 | OxyTs OxyTs OxyAs OxyTs DNAas DNAas DNAts DNAgs DNAas DNAcs DNAas DNAgs OxyGs OxyAs OxyT |
| 248 | 64358 | 64377 | TATTTCTTCTTTCTGTACT | ASO-0316 | OxyAs OxyTs OxyTs OxyTs DNAas DNAcs DNAts DNAas DNAts DNAas OxyMCs OxyA |
| 249 | 64756 | 64775 | AGGGAAGGCAAATCTACAT | ASO-0317 | OxyAs OxyAs DNAts DNAts DNAts DNAgs DNAas DNAts DNAts DNAgs DNAts DNAcs DNAts OxyMCs OxyT |
| 250 | 64986 | 65003 | ACAGAGAAGGTAATGCAT | ASO-0318 | OxyAs OxyGs OxyGs DNAgs DNAas DNAas DNAts DNAas DNAts DNAts DNAcs DNAas DNAas OxyT |
| 251 | 65329 | 65348 | TAAGTGTATTT | ASO-0319 | OxyAs OxyMCs OxyAs OxyGs DNAas DNAgs DNAts DNAas DNAts DNAgs DNAts DNAcs OxyAs OxyGs DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 252 | 65338 | 65357 | GTAGGGGCC | 0320 | DNAgs DNAts DNAAs DNAgs DNAgs DNAgs OxyMCs OxyMC |
| 253 | 65831 | 65357 | GCTATTAGGTA AGTGTATTT | ASO-0025 | OxyGs OxyMCs OxyTs DNAAs DNAts DNAAs DNAgs DNAgs DNAts DNAAs DNAgs DNAts DNAAs DNAts OxyTs OxyT |
| 253 | 65831 | 65849 | CCTTTACCTCA TTCAAAAC | ASO-0321 | OxyMCs OxyMCs DNAts DNAts DNAAs DNAcs DNAts DNAcs DNAaS DNAts DNAts DNAts DNAAs OxyAs OxyAs OxyMC |
| 254 | 65833 | 65849 | CCTTTACCTCA TTCAAA | ASO-0322 | OxyMCs OxyMCs DNAts DNAts DNAAs DNAts DNAts DNAcs DNAcs DNAts DNAcs DNAAs DNAts OxyAs OxyAs OxyA |
| 255 | 66693 | 66712 | AAGAGTAAGTA AAATAAAGA | ASO-0323 | OxyAs OxyAs OxyGs OxyAs DNAgs DNAts DNAas DNAgs DNAts DNAas DNAgs DNAts DNAAs DNAts DNAts OxyAs OxyGs OxyA |
| 256 | 66728 | 66744 | CTTGGAATTTG TGGGAT | ASO-0324 | OxyMCs OxyTs OxyTs OxyGs DNAgs DNAas DNAts DNAts DNAts DNAts DNAts OxyAs OxyT |
| 257 | 66984 | 67001 | GTTTATAGATT GATTCAT | ASO-0325 | OxyGs OxyTs OxyTs DNAas DNAts DNAas DNAgs DNAas DNAts DNAts OxyMCs OxyAs OxyT |
| 258 | 67218 | 67236 | AGTAATTTATAA GAACATT | ASO-0326 | OxyAs OxyGs OxyTs OxyAs DNAas DNAts DNAts DNAts DNAAs DNAts DNAas OxyAs OxyTs OxyT |
| 259 | 67545 | 67563 | CAATGTGTTTA TGTTTTGA | ASO-0327 | OxyMCs OxyAs OxyAs OxyTs DNAgs DNAts DNAts DNAts DNAts OxyTs OxyGs OxyA |
| 260 | 68059 | 68078 | TTTCTAATTTTC ATGTCTAT | ASO-0328 | OxyTs OxyTs OxyTs OxyMCs DNAts DNAas DNAts DNAts DNAts DNAas OxyTs OxyAs OxyT |
| 261 | 68336 | 68353 | ATTGTTTCTCAT ATTCCC | ASO-0329 | OxyAs DNAts DNAas DNAgs DNAts DNAts DNAts OxyMCs OxyMCs OxyMC |
| 262 | 68408 | 68425 | AAACATCAAGT AAAGGCA | ASO-0330 | OxyAs OxyAs OxyAs OxyMCs DNAts DNAas OxyGs OxyMCs OxyA |
| 263 | 68767 | 68783 | ATTCTGAGTAA GGGGTC | ASO-0331 | OxyAs OxyTs OxyTs DNAcs DNAts DNAgs DNAas DNAts DNAas DNAts OxyTs OxyMC |
| 264 | 69068 | 69086 | ATACATTTTACA TTATTCT | ASO-0332 | DNAgs DNAgs DNAgs DNAgs OxyGs OxyTs OxyMC |
| 266 | 69608 | 69625 | CTACATTAAAAT ATGGCC | ASO-0335 | OxyMCs OxyTs OxyAs OxyMCs DNAts DNAas DNAts DNAts DNAas DNAas OxyMCs OxyMC |
| 267 | 69781 | 69798 | TTCATAAATTCC AGGTGC | ASO-0336 | OxyTs OxyTs OxyMCs OxyAs DNAts DNAas DNAas DNAts DNAts OxyGs OxyMC |
| 268 | 69942 | 69960 | TAGCAATACAT GAGAAGAA | ASO-0026 | OxyTs DNAas DNAas DNAts DNAas DNAts DNAas OxyGs OxyAs OxyA |
| 269 | 70003 | 70020 | ATTCTGTGTTG TGCTTTA | ASO-0337 | OxyAs OxyTs OxyTs OxyMCs DNAts DNAas DNAts DNAgs DNAts DNAts OxyTs OxyA |
| 270 | 70130 | 70147 | GAGTAAATGTT TCTGAAT | ASO-0338 | OxyGs OxyAs OxyGs OxyTs DNAas DNAas DNAts DNAcs DNAts DNAts OxyT |
| 271 | 70606 | 70623 | TATATACTTTAG | ASO- | OxyTs OxyTs OxyAs OxyTs OxyAs DNAts DNAcs DNAts DNAts DNAts DNAcs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 272 | 71071 | 71090 | CTGTATTTATTA GTTCCAC | ASO-0340 | OxyMCs OxyTs DNAgs DNAts DNAts DNAts DNAts DNAas DNAas DNAgs DNAts DNAas DNAts DNAcs OxyMCs OxyAs OxyA |
| 273 | 71222 | 71239 | TTCTTACTAATG TTGAAC | ASO-0341 | OxyTs OxyMCs OxyTs DNAts DNAas DNAts DNAas DNAts DNAas OxyGs OxyAs OxyAs OxyMC |
| 274 | 71370 | 71389 | ATTATACATTTT ATTATTAT | ASO-0342 | OxyAs OxyTs OxyTs OxyAs DNAts DNAas DNAcs DNAas DNAts DNAts OxyTs OxyAs OxyT |
| 275 | 71872 | 71889 | AGGTGACATAA GAGAACC | ASO-0343 | OxyAs OxyGs OxyGs DNAts DNAgs DNAas DNAcs DNAas DNAts DNAas OxyAs OxyMCs OxyMC |
| 276 | 71912 | 71929 | ACATTAAGTTT GAATACC | ASO-0344 | OxyAs OxyMCs OxyAs OxyTs DNAts DNAas DNAgs DNAas DNAts DNAts OxyAs OxyMCs OxyMC |
| 277 | 72300 | 72318 | TTTTCTCTGGC TTAAATAT | ASO-0345 | OxyTs DNAts DNAts DNAts DNAcs DNAts DNAcs DNAts OxyGs OxyAs OxyT |
| 278 | 73019 | 73038 | ATTAATATACAA AGAAGATG | ASO-0346 | OxyAs OxyTs OxyTs OxyAs DNAas DNAts DNAas DNAas OxyGs OxyAs OxyTs OxyG |
| 279 | 73024 | 73041 | CAGATTAATAT ACAAAGA | ASO-0347 | OxyMCs OxyAs OxyGs OxyAs DNAts DNAts DNAas DNAts DNAts DNAas OxyAs OxyGs OxyA |
| 280 | 73605 | 73621 | AAGCTTTAGTG GGAGGG | ASO-0348 | OxyAs OxyAs OxyGs DNAcs DNAts DNAts DNAts DNAas DNAgs OxyGs OxyG |
| 281 | 74353 | 74369 | ACAAAGGGTAG TAATAT | ASO-0349 | OxyAs OxyMCs OxyAs DNAas DNAgs DNAgs DNAts OxyAs OxyT |
| 282 | 74557 | 74574 | CTTACATGTCA TTTTCTG | ASO-0350 | OxyMCs DNAts DNAts DNAts DNAts OxyMCs OxyTs OxyG |
| 283 | 75074 | 75093 | TCTTATTTACAA TACAGGTA | ASO-0027 | OxyTs OxyMCs OxyTs DNAts DNAas DNAts DNAts DNAgs OxyGs OxyTs OxyA |
| 284 | 75414 | 75431 | TCAAACATTTCT TTAGGA | ASO-0351 | OxyTs OxyMCs OxyAs DNAas DNAcs DNAas DNAts DNAts DNAts DNAcs DNAas OxyGs OxyA |
| 285 | 75419 | 75438 | TAATAATTCAAA CATTTCTT | ASO-0352 | OxyTs OxyAs OxyAs DNAas DNAts DNAts DNAcs OxyMCs OxyTs OxyT |
| 286 | 75815 | 75833 | GAATAATGAAT AAATGCCA | ASO-0353 | OxyGs OxyAs OxyAs OxyTs DNAats DNAas DNAts DNAts OxyMCs OxyMCs OxyA |
| 304 | 76173 | 76189 | TATTGTGGAGT ATGGAA | ASO-0388 | OxyTs OxyAs OxyAs OxyTs DNAgs DNAgs DNAas DNAas OxyGs OxyA |
| 305 | 76334 | 76351 | GAAAGGTAATA AATTAGG | ASO-0389 | OxyGs OxyAs OxyAs OxyAs DNAts DNAas DNAats DNAas DNAas OxyGs OxyG |
| 306 | 77425 | 77443 | TGGAAGGTAAA TGACTGAA | ASO-0390 | OxyTs OxyGs OxyGs DNAgs DNAats DNAts DNAas DNAas OxyTs OxyGs OxyAs OxyA |
| 307 | 77701 | 77720 | ATGAAAATTGT | ASO- | OxyAs OxyTs OxyGs OxyAs DNAts DNAas DNAas DNAts DNAas DNAas DNAgs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 308 | 77709 | 77726 | ATCTGTAAA | ASO-0391 | DNAas DNAts DNAcs DNAts DNAgs OxyTs OxyAs OxyGs OxyA |
| 309 | 78259 | 78278 | AAGCTAATGAA AATTGTA | ASO-0392 | OxyAs OxyGs OxyMCs DNAts DNAas DNAts DNAgs DNAas DNAas DNAts DNAaas DNAts OxyTs OxyGs OxyTs OxyA |
| 310 | 78542 | 78558 | AAGGAATAGCA TGATTAACA | ASO-0393 | OxyAs OxyGs OxyGs DNAas DNAts DNAts OxyAas OxyMCs OxyA DNAts DNAgs DNAas DNAts DNAts OxyAs OxyAs OxyMCs OxyA |
| 311 | 78838 | 78855 | TGGCTGAGAG GTGAATC | ASO-0394 | OxyTs OxyGs OxyGs DNAcs DNAts DNAgs DNAas DNAgs OxyTs OxyMC DNAgs DNAts DNAgs DNAas DNAas OxyTs OxyMC |
| 312 | 79088 | 79107 | TCTAAATTAAA GTGAAGA | ASO-0395 | OxyTs OxyMCs OxyTs OxyAs DNAas DNAts DNAts DNAas DNAas DNAts DNAgs DNAts DNAgs OxyAs OxyGs OxyA |
| 313 | 79090 | 79107 | TGAAGTCAAAA TTAGTCATC | ASO-0028 | OxyTs OxyGs OxyAs DNAas DNAgs DNAts DNAcs DNAas DNAas DNAts DNAts OxyMCs OxyAs OxyTs OxyMC |
| 314 | 79400 | 79417 | TGAAGTCAAAA TTAGTCA | ASO-0396 | OxyTs OxyGs OxyAs DNAgs DNAts DNAcs DNAas DNAas DNAts DNAts OxyGs OxyTs OxyMCs OxyA |
| 315 | 81257 | 81273 | ATTTACTTCAGT ACCATT | ASO-0397 | OxyAs OxyTs OxyTs DNAas DNAcs OxyMCs OxyAs OxyTs OxyT DNAts DNAas DNAcs DNAgs DNAts DNAts DNAgs DNAas DNAts |
| 316 | 81553 | 81570 | GCTGCTTTGAT AGATGA | ASO-0398 | OxyGs DNAcs DNAts DNAgs DNAcs DNAts DNAts DNAgs DNAas DNAts DNAas DNAgs OxyAs OxyTs OxyGs OxyA |
| 317 | 81771 | 81787 | GTGCTGGGGT CTTAACTT | ASO-0399 | OxyGs DNAts DNAgs DNAcs DNAts DNAgs DNAgs DNAgs DNAts DNAcs DNAcs DNAts DNAas DNAcs OxyTs OxyT |
| 318 | 82146 | 82165 | TATTTAAGTTCT TGTCA | ASO-0400 | OxyTs OxyAs DNAts DNAts OxyTs DNAas DNAas DNAgs DNAts DNAts OxyGs OxyTs OxyMCs OxyA |
| 319 | 82479 | 82498 | ACTTCATAGTA GGTGTCAGA | ASO-0401 | OxyAs DNAcs DNAts DNAts DNAcs DNAas DNAts DNAas DNAgs DNAts DNAas OxyGs OxyGs OxyA |
| 320 | 82701 | 82720 | TTAATTCTTCCC TAGATGTC | ASO-0402 | OxyTs DNAts DNAas DNAas DNAts DNAts DNAcs DNAts DNAts DNAcs DNAcs DNAcs DNAts DNAas DNAgs OxyTs OxyMC |
| 321 | 82880 | 82897 | AAGGTTGTTAA TGCTAAAGA | ASO-0403 | OxyAs OxyAs OxyGs DNAgs DNAts DNAts DNAgs DNAts DNAts DNAas DNAas DNAts DNAgs DNAcs DNAts DNAas OxyAs OxyGs OxyA |
| 322 | 83174 | 83190 | TAATACTTTATG TAATAG | ASO-0404 | OxyTs OxyAs OxyAs DNAts DNAas DNAcs DNAts DNAts DNAts DNAas DNAts DNAgs DNAts DNAas DNAas DNAts OxyAs OxyAs OxyG |
| 323 | 83423 | 83441 | ATTCTTAAAGG TCTAAG | ASO-0405 | OxyAs OxyTs OxyTs OxyMCs DNAts DNAts DNAas DNAas DNAas DNAgs DNAgs DNAts DNAcs DNAts DNAas DNAas OxyAs OxyG |
| 324 | 83475 | 83491 | TAGTTGACACA TATTATAA | ASO-0029 | OxyTs OxyAs OxyGs OxyTs DNAts DNAgs DNAas DNAcs DNAas DNAcs DNAas OxyTs OxyAs OxyTs OxyAs OxyA |
| 325 | 83877 | 83895 | GTGATTTTATA GTTGGT | ASO-0406 | OxyGs OxyTs OxyGs OxyAs DNAts DNAts DNAts DNAts DNAas DNAts DNAas DNAts DNAts DNAts DNAas OxyGs OxyT |
| 326 | 84066 | 84083 | GAATATTTTATA ATTTGAT | ASO-0407 | OxyGs OxyAs OxyAs OxyTs DNAts DNAts DNAts DNAts DNAas DNAts DNAas DNAts DNAts OxyTs OxyGs OxyAs OxyT |
|  |  |  | TACATATAAATC | ASO- | OxyTs OxyAs OxyMCs OxyAs DNAts DNAas DNAts DNAas DNAas DNAts DNAas DNAts DNAts DNAaas DNAts DNAaas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 327 | 84562 | 84581 | TTTGTTTCACC ATTTTATAC | ASO-0408 | DNAts DNAcs DNAts DNAgs DNAas OxyAs OxyGs OxyG |
| 328 | 84563 | 84581 | TTTGTTTCACC ATTTTATA | ASO-0409 | OxyTs OxyTs DNAgs DNAts DNAts DNAcs DNAas DNAcs DNAas DNAts DNAts DNAas OxyTs OxyAs OxyMC |
| 329 | 84941 | 84960 | CTATGTCAATTT AATTCTTA | ASO-0410 | OxyTs OxyTs OxyGs DNAts DNAts DNAts DNAcs DNAas DNAcs DNAts DNAts DNAas OxyTs OxyA |
| 330 | 85428 | 85447 | TTATTTACTTTG CTCCACAC | ASO-0411 | OxyMCs OxyTs OxyAs DNAts DNAgs DNAts DNAcs DNAas DNAts DNAts OxyMCs OxyTs OxyA |
| 331 | 85432 | 85449 | CTTTATTTACTT TGCTCC | ASO-0412 | OxyTs OxyTs DNAas DNAts DNAts DNAts DNAcs DNAas DNAts DNAcs DNAts DNAts DNAcs OxyAs OxyMC |
| 332 | 86205 | 86223 | AGTCAGAGAGG TAAAATTC | ASO-0413 | OxyMCs DNAts DNAgs DNAts DNAts DNAts DNAts DNAas DNAts DNAts DNAcs DNAts OxyT OxyMCs OxyMC |
| 333 | 86473 | 86490 | GAATGATAAAA GTTTACA | ASO-0414 | OxyAs OxyGs OxyTs OxyMCs DNAas DNAas DNAgs DNAas DNAgs DNAas OxyAs OxyTs OxyMC |
| 334 | 86476 | 86495 | ATGGAGAATGA TAAAAGTTT | ASO-0415 | OxyGs OxyAs OxyAs OxyTs DNAgs DNAas DNAas DNAts DNAas DNAts DNAgs DNAas OxyMCs OxyA |
| 335 | 86477 | 86494 | TGGAGAATGAT AAAAGTT | ASO-0030 | OxyAs OxyTs OxyGs OxyGs OxyAs DNAgs DNAas DNAas OxyGs DNAas OxyGs OxyTs OxyT |
| 336 | 87943 | 87959 | CTAGATGGTTA GAATTC | ASO-0416 | OxyTs OxyGs OxyGs OxyAs DNAgs OxyAs DNAgs DNAts DNAts DNAgs DNAts DNAts DNAgs OxyTs OxyT |
| 337 | 89252 | 89271 | ATATATTTTAAT TCTATTAA | ASO-0417 | OxyMCs OxyTs OxyAs OxyGs DNAas OxyAs OxyTs OxyTs OxyMC |
| 338 | 89426 | 89442 | TAGCTGTTTTG GAAGAT | ASO-0418 | OxyAs DNAgs DNAas DNAgs OxyAs OxyTs OxyGs OxyT |
| 339 | 89534 | 89550 | AGTTGAGATA CTATGT | ASO-0419 | OxyAs OxyGs OxyTs OxyTs DNAts DNAgs DNAas DNAgs DNAts DNAts DNAas |
| 340 | 89977 | 89994 | TTCACTTTTGA GTTTAAT | ASO-0420 | OxyTs OxyTs OxyAs OxyMCs DNAts DNAcs DNAts DNAts DNAts DNAgs DNAas OxyT |
| 341 | 90288 | 90305 | TAGTTTAGGTT TAATAAA | ASO-0421 | OxyTs OxyAs OxyGs OxyTs DNAts DNAas DNAgs DNAgs DNAts DNAts OxyA |
| 342 | 90666 | 90684 | ATTTAGAAGAA TAAAGGGA | ASO-0422 | OxyAs OxyTs OxyTs DNAas OxyAs OxyAs OxyAs OxyA |
| 343 | 90891 | 90907 | CACTTACTTCA GGGATT | ASO-0423 | OxyAs OxyAs OxyMCs DNAas DNAts DNAcs DNAts DNAcs DNAgs OxyGs OxyA |
| 344 | 91334 | 91350 | CTTAGATGTAA TTTTGC | ASO-0424 | OxyMCs OxyTs OxyTs OxyAs DNAgs DNAas DNAts DNAts DNAgs DNAts DNAas |
| 345 | 91479 | 91496 | AATTTGTCTATA | ASO-0425 | OxyAs OxyAs OxyAs OxyTs OxyTs DNAts DNAas DNAts DNAcs DNAts DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 346 | 91524 | 91540 | TCTTTA TATAAGGATAT TAGTTG | ASO-0426 | DNAas DNAts DNAcs OxyTs OxyAs OxyTs OxyA OxyTs OxyAs OxyAs DNAas DNAgs DNAgs DNAas DNAts DNAts DNAts DNAas OxyGs OxyTs OxyTs OxyG |
| 347 | 92407 | 92424 | TGGTGGACTGT AGATTTC | ASO-0428 | OxyTs OxyGs DNAgs DNAts DNAgs DNAas DNAcs DNAts DNAgs DNAts OxyTs OxyTs OxyMC |
| 348 | 92646 | 92663 | GTTTATTTAATG TCTGAT | ASO-0429 | DNAas DNAgs DNAts DNAts DNAts DNAts DNAas DNAas DNAts OxyGs OxyTs OxyTs DNAas DNAts DNAts DNAas DNAts |
| 349 | 92967 | 92984 | GCTGCTGTATA ATATATT | ASO-0430 | DNAgs DNAts DNAcs OxyTs OxyGs OxyAs DNAts DNAgs DNAts DNAas DNAts DNAas DNAas DNAts DNAas OxyTs OxyT |
| 350 | 92982 | 93000 | AATTGTTTAAG AGGGAGCT | ASO-0031 | OxyAs DNAas DNAts DNAts DNAts DNAts DNAgs DNAas DNAts DNAts DNAas DNAgs DNAgs DNAgs OxyAs OxyGs OxyMCs OxyT |
| 351 | 93112 | 93128 | TTATTTGTCTGA GTGTA | ASO-0431 | OxyTs OxyAs OxyTs DNAts DNAts DNAts DNAgs DNAts DNAts DNAas OxyGs DNAas DNAgs DNAts DNAgs OxyTs OxyA |
| 352 | 93636 | 93655 | ACACACTGTAA GAGACAAGC | ASO-0432 | OxyAs DNAcs DNAcs DNAas DNAcs DNAts DNAgs DNAts DNAas DNAas OxyGs OxyMC DNAgs DNAas DNAgs DNAas DNAcs OxyAs |
| 353 | 93638 | 93655 | ACACACTGTAA GAGACAA | ASO-0433 | OxyAs OxyMCs OxyMCs DNAas DNAcs DNAts DNAgs DNAts DNAas DNAas OxyMCs OxyAs OxyA DNAas DNAgs DNAas DNAgs OxyAs DNAts |
| 354 | 94310 | 94328 | TTAAGTAGGTC ACATTTAA | ASO-0434 | OxyTs OxyTs OxyAs OxyAs DNAgs DNAts DNAas DNAgs DNAgs DNAts DNAcs OxyAs DNAas DNAas DNAts DNAas OxyTs OxyAs OxyA |
| 355 | 94313 | 94330 | ATTTAAGTAGG TCACATT | ASO-0435 | OxyAs OxyTs OxyTs OxyTs DNAas DNAas DNAgs DNAts DNAas DNAgs DNAgs DNAts DNAcs OxyAs OxyTs OxyT |
| 356 | 95510 | 95529 | ATTAGCATTAAT TATTACTC | ASO-0436 | OxyAs OxyTs OxyTs OxyAs DNAgs DNAcs DNAas DNAts DNAts DNAas OxyAs DNAas OxyMCs OxyTs OxyMC |
| 357 | 95516 | 95535 | CTCATTATTAG CATTAATTA | ASO-0437 | OxyMCs OxyTs OxyMCs OxyAs DNAts DNAts DNAas DNAts DNAts DNAts DNAas OxyAs OxyTs OxyA |
| 358 | 95891 | 95908 | ATGAGGTGGAA AATGTGA | ASO-0438 | DNAgs DNAcs DNAas DNAts DNAas DNAgs DNAgs DNAts DNAgs DNAgs DNAas OxyGs OxyTs OxyGs OxyA |
| 359 | 96245 | 96264 | TTATCATTTAAT ATTTATTA | ASO-0439 | OxyTs OxyTs OxyAs OxyTs DNAcs DNAas DNAts DNAts DNAts DNAas DNAas OxyAs OxyTs OxyT OxyA |
| 360 | 96525 | 96544 | GTGAGGAGTGA TTAAATACC | ASO-0440 | OxyGs OxyTs OxyGs DNAas DNAgs DNAgs DNAas DNAgs DNAts DNAgs DNAas DNAts DNAts DNAas DNAas OxyMCs OxyMC |
| 361 | 96798 | 96817 | GACTTTATAAC AATAGTACT | ASO-0441 | OxyGs OxyAs OxyMCs DNAts DNAts DNAts DNAas DNAts DNAas DNAas DNAcs DNAas DNAas OxyTs OxyAs OxyMCs OxyT |
| 362 | 97132 | 97151 | GCATCTTAGAA TTTGTCTGC | ASO-0442 | OxyGs DNAcs DNAas DNAts DNAcs DNAts DNAts DNAas DNAgs DNAas DNAas DNAts DNAts DNAts DNAgs DNAts DNAcs OxyGs OxyMC |
| 363 | 97133 | 97151 | GCATCTTAGAA TTTGTCTG | ASO-0032 | OxyGs OxyMCs OxyAs DNAts DNAcs DNAts DNAts DNAas DNAgs DNAas DNAas DNAts DNAts DNAts DNAgs OxyTs OxyG |
| 364 | 97147 | 97163 | AGGATTATTAG | ASO- | OxyAs OxyGs DNAgs DNAas DNAts DNAts DNAas DNAts DNAts DNAts DNAas DNAgs DNAts DNAcs DNAas DNAcs OxyTs DNAas DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 365 | 97969 | 97988 | ATGTTTAAAGAGGTGACTGA | ASO-0443 | DNAgs DNAgs OxyMCs OxyAs OxyTs OxyMC DNAgs DNAgs DNAgs DNAgs DNAgs DNAgs DNAgs DNAas |
| 366 | 98248 | 98264 | GTTATGGAGACAGGGAT | ASO-0444 | OxyAs OxyTs OxyGs DNAts DNAts DNAgs DNAgs DNAgs OxyTs OxyGs OxyA |
| 367 | 98254 | 98271 | GAATTTTGTTATGGAGAC | ASO-0445 | OxyGs DNAts DNAts DNAas DNAgs DNAgs OxyGs OxyAs OxyT |
| 368 | 98912 | 98931 | AGTGTCTTAATAATCAGCC | ASO-0446 | OxyGs OxyAs OxyAs OxyTs DNAts DNAts DNAgs DNAts DNAas DNAgs OxyGs OxyMC |
| 369 | 99114 | 99131 | TTTGGAAATAGTTTTGAC | ASO-0447 | OxyAs OxyGs DNAts DNAgs DNAts DNAcs DNAas DNAgs OxyMCs OxyMC |
| 370 | 99504 | 99522 | AATATTCTTCTTGATTTT | ASO-0448 | OxyTs OxyTs OxyTs OxyGs DNAas DNAas DNAts OxyTs OxyGs OxyAs OxyMC |
| 371 | 99506 | 99524 | TTAATATTCTTCTTTGATT | ASO-0449 | OxyAs OxyAs OxyTs OxyAs DNAts DNAgs DNAas OxyTs OxyTs OxyT |
| 372 | 99980 | 99996 | TAGTTCAACAATCTAAT | ASO-0450 | OxyTs OxyAs OxyAs OxyAs DNAts DNAts DNAts OxyGs OxyAs OxyTs OxyT |
| 373 | 100155 | 100173 | TTTCTAGTTTCTGATGATC | ASO-0451 | OxyTs OxyAs OxyAs OxyGs OxyTs DNAts DNAcs DNAts DNAts OxyAs OxyT |
| 374 | 100155 | 100174 | CTTTCTAGTTTCTGATGATC | ASO-0452 | OxyTs OxyTs OxyTs DNAts DNAas DNAts OxyGs OxyAs OxyTs OxyMC |
| 375 | 100156 | 100173 | TTTCTAGTTTCTGATGAT | ASO-0453 | OxyMCs DNAts DNAts DNAas DNAgs DNAts DNAas DNAgs OxyAs OxyTs OxyMC |
| 376 | 100156 | 100174 | CTTTCTAGTTTCTGATGAT | ASO-0454 | OxyTs OxyTs OxyTs DNAcs DNAts DNAas OxyAs OxyT |
| 377 | 100156 | 100175 | TCTTTCTAGTTTCTGATGAT | ASO-0455 | OxyMCs OxyTs OxyTs OxyTs DNAts DNAgs DNAts DNAgs OxyAs OxyT |
| 378 | 100207 | 100223 | GTTCTCACCAATATTAG | ASO-0456 | OxyTs OxyMCs DNAts DNAcs DNAts DNAgs OxyAs OxyT |
| 379 | 100299 | 100317 | AAAGTTATAAATATTCTAG | ASO-0457 | OxyGs OxyTs OxyMCs OxyMCs DNAts DNAts OxyTs OxyAs OxyG |
| 380 | 100520 | 100538 | TATTTATTCTTTAAATTAC | ASO-0458 | OxyAs OxyAs OxyAs OxyGs DNAts DNAts OxyMCs OxyTs OxyAs OxyG |
| 381 | 100773 | 100789 | TGAGACCTTATATTATT | ASO-0459 | OxyTs OxyGs OxyTs DNAts DNAcs DNAts OxyTs OxyMC |
| 382 | 101632 | 101649 | GTTTCTTATATTCATCAC | ASO-0460 | OxyTs OxyGs OxyTs DNAts DNAcs DNAts OxyAs OxyTs OxyT |
| 383 | 101749 | 101767 | AACAATAAAAATT | ASO-0461 | OxyGs OxyTs DNAts DNAts DNAcs OxyMCs OxyAs OxyG |
| | | | | ASO- | OxyAs OxyAs OxyMCs OxyAs DNAas DNAas DNAts DNAts DNAas DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 384 | 101988 | 102007 | GAATGATATAGGTGAATTTG | ASO-0033 | OxyGs OxyAs OxyTs DNAgs DNAas DNAts DNAas DNAgs DNAgs DNAts DNAgs DNAas OxyTs OxyGs OxyTs OxyG |
| 436 | 102094 | 102111 | CAGAGTTGTTTGTTCTC | ASO-0565 | OxyMCs OxyAs DNAgs DNAts DNAts DNAgs DNAts DNAts DNAts DNAts DNAts DNAgs DNAts DNAgs DNAts DNAgs DNAts DNAgs DNAts DNAgs OxyMCs OxyTs OxyMC |
| 437 | 102432 | 102448 | AGGTTATCAGTGTGGGC | ASO-0566 | OxyAs DNAgs DNAgs DNAts DNAts DNAts DNAts DNAas DNAgs DNAts DNAgs OxyGs OxyMC |
| 438 | 102681 | 102700 | AACAAATAACAACTTTCTGC | ASO-0567 | OxyAs OxyAs OxyMCs DNAas DNAas DNAts DNAas DNAts DNAas DNAts OxyMCs OxyTs OxyGs OxyMC |
| 439 | 102859 | 102875 | TTTATAAGTTTAGTCTG | ASO-0568 | OxyTs OxyTs OxyTs OxyAs DNAts DNAas DNAas DNAgs DNAts DNAts DNAts OxyMCs OxyTs OxyG |
| 440 | 103247 | 103266 | ATATTGGTCTGTTTGTTCC | ASO-0569 | OxyAs DNAts DNAts DNAts DNAgs DNAgs DNAts DNAts DNAts OxyMCs OxyMC |
| 441 | 103690 | 103708 | AAATCGTTCTTACATGAA | ASO-0570 | OxyAs OxyAs OxyAs OxyTs DNAmcs DNAgs DNAts DNAts DNAts OxyGs OxyAs OxyA |
| 442 | 103692 | 103711 | TTAAAATCGTTCTTTACATG | ASO-0034 | OxyTs OxyTs OxyAs OxyAs DNAas DNAts DNAts DNAmcs DNAts DNAmcs OxyAs OxyTs OxyG |
| 443 | 103695 | 103712 | TTTAAAATCGTTCTTTAC | ASO-0571 | OxyTs OxyTs OxyTs OxyAs DNAas DNAas DNAts DNAts DNAts DNAmcs DNAgs DNAts DNAmcs OxyMC |
| 444 | 104211 | 104228 | AGTTGGTTTAAAATGTGT | ASO-0572 | OxyAs OxyGs OxyTs OxyTs DNAgs DNAgs DNAts DNAts DNAts DNAas DNAts OxyGs OxyT |
| 445 | 104304 | 104321 | TTCCAAATTTTCCACTAA | ASO-0573 | OxyTs OxyTs OxyTs OxyAs DNAts DNAts DNAts OxyMCs DNAts OxyAs OxyA |
| 446 | 104608 | 104625 | ATTATTATGGTGTTTTGT | ASO-0574 | OxyAs OxyTs OxyTs OxyAs DNAts DNAts DNAts DNAts DNAts DNAts DNAgs DNAgs DNAts OxyGs OxyT |
| 447 | 112262 | 112280 | GCATACATAATTATTTGTC | ASO-0575 | OxyGs OxyMCs OxyAs DNAts DNAas DNAts DNAts DNAts DNAts OxyGs OxyTs OxyMC |
| 448 | 112263 | 112282 | TTGCATACATAATTATTTGT | ASO-0035 | OxyTs OxyTs OxyGs DNAts DNAts DNAts DNAts DNAas DNAts OxyTs OxyGs OxyT |
| 449 | 112345 | 112361 | ATTCTTAGCTTGTATGT | ASO-0576 | OxyAs OxyTs OxyMCs OxyTs DNAts DNAts DNAts DNAts OxyGs OxyT |
| 450 | 112542 | 112559 | TTATTCTCAATCAACTTT | ASO-0577 | OxyTs OxyTs OxyAs DNAts DNAts DNAts DNAts DNAts OxyTs OxyT |
| 451 | 113328 | 113344 | CTTTAGTGGACAGAATG | ASO-0578 | OxyMCs OxyTs OxyTs DNAts DNAgs DNAts DNAts DNAts DNAgs DNAas |
| 452 | 113553 | 113570 | TCATCATTCTGTCTATGG | ASO-0579 | OxyTs OxyMCs OxyAs DNAts DNAts DNAts DNAts DNAts OxyGs OxyG |
| 453 | 113769 | 113786 | GTTGGATTATT | ASO- | OxyGs OxyTs OxyTs OxyGs DNAgs DNAas DNAts DNAts DNAts DNAts DNAts DNAgs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 454 | 114111 | 114127 | ATTGTAA | 0580 | DNAas DNAts DNAT OxyGs DNAts OxyGs OxyTs OxyAs OxyA |
| 455 | 114576 | 114594 | GACCAGAAGATGTAATT | ASO-0581 | OxyGs OxyAs OxyMCs OxyMCs DNAas DNAgs DNAas DNAgs DNAas DNAts DNAgs DNAas OxyAs OxyTs OxyT |
| 456 | 114692 | 114710 | AAGCAGTTTATTTTCTTTA | ASO-0582 | OxyAs OxyAs OxyGs OxyMCs DNAas DNAgs DNAts DNAas DNAgs DNAts DNAts OxyTs OxyA |
| 457 | 114694 | 114710 | TAGATTTATAAGGATTGTA | ASO-0036 | OxyTs OxyAs OxyGs OxyAs DNAts DNAts DNAts OxyGs OxyTs OxyA |
| 458 | 115587 | 115606 | TAGATTTATAAGGATTG | ASO-0583 | OxyTs OxyAs OxyGs OxyAs DNAts DNAts DNAts OxyTs OxyG |
| 459 | 115589 | 115606 | AGGTACAATAATAAACAAGA | ASO-0584 | DNAgs DNAgs OxyAs OxyTs OxyTs OxyG |
| 460 | 115944 | 115960 | AGGTACAATAATAAACAA | ASO-0585 | OxyAs OxyGs OxyGs OxyTs DNAas DNAcs DNAas DNAas DNAts DNAas DNAts DNAas OxyAs OxyGs OxyA |
| 461 | 116188 | 116206 | AGATGTTAAGGAAGGTC | ASO-0586 | OxyAs OxyGs OxyAs OxyTs DNAgs DNAts DNAas DNAts DNAts OxyMCs OxyAs OxyA |
| 462 | 116499 | 116516 | AATCCATGACATTTATTGA | ASO-0587 | OxyAs OxyAs OxyTs OxyMCs DNAcs DNAas DNAts DNAgs DNAas DNAcs DNAts OxyTs OxyGs OxyA |
| 463 | 116502 | 116519 | ATGAAGTTTCTGTGGCTG | ASO-0588 | OxyAs OxyTs DNAgs DNAas DNAgs DNAgs DNAcs OxyTs OxyG |
| 464 | 117064 | 117079 | TTTATGAAGTTTCTGTGG | ASO-0589 | OxyTs OxyTs OxyTs DNAas DNAgs DNAas OxyTs OxyGs OxyG |
| 465 | 117269 | 117285 | GCATTAGGGAGTTCAG | ASO-0590 | OxyGs OxyMCs OxyAs OxyTs DNAts DNAas OxyAs OxyG |
| 466 | 117601 | 117618 | CATTAGACCTAGAATTG | ASO-0591 | OxyMCs OxyAs OxyTs DNAas DNAgs DNAas DNAcs DNAas OxyG OxyTs OxyG |
| 467 | 117904 | 117921 | AAGTTTAAAAGTAAGAGC | ASO-0592 | OxyAs OxyAs OxyGs OxyTs DNAas DNAas DNAgs DNAas OxyAs OxyGs OxyMC |
| 468 | 119540 | 119556 | GTCTTATATTACATCAAA | ASO-0593 | OxyGs OxyTs OxyTs DNAas DNAas DNAts DNAas DNAts OxyAs OxyA |
| 469 | 119776 | 119795 | AATTGAGGGACAGGTAG | ASO-0594 | OxyAs OxyAs DNAts DNAts DNAgs DNAas OxyTs OxyAs OxyG |
| 470 | 119780 | 119799 | AATCTGCCATTTTATCAAGG | ASO-0595 | OxyAs OxyAs DNAts DNAts DNAcs DNAas DNAts DNAas OxyAs OxyGs OxyG |
| 471 | 119782 | 119799 | CAAGAATCTGCCATTTATC | ASO-0037 | OxyMCs OxyAs OxyAs DNAgs DNAas DNAts DNAts DNAas OxyTs OxyMC |
| 472 | 120301 | 120317 | CAAGAATCTGCCATTTTA | ASO-0596 | OxyMCs OxyAs OxyAs DNAgs DNAas DNAts DNAts DNAas OxyTs OxyG |
|  |  |  | TTACTGGGAAT | ASO- | OxyTs OxyTs OxyAs OxyAs OxyMCs DNAts DNAgs DNAas DNAts DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 473 | 120625 | 120644 | TTAGTTACCCTTCATAA ACTAAGCAA | ASO-0597 | DNAts DNAts DNAts OxyAs OxyGs OxyTs OxyT OxyAs OxyMCs OxyMCs DNAcs DNAts DNAts DNAts DNAas DNAts DNAas DNAcs DNAts DNAas DNAcs DNAts DNAas DNAgs DNAas OxyAs OxyA |
| 474 | 121026 | 121044 | TAACTTTCATAA TTTGGAG | ASO-0599 | OxyTs OxyAs OxyAs DNAas DNAts DNAts DNAts DNAts DNAas DNAts DNAcs DNAas DNAts DNAas OxyGs OxyAs OxyG DNAas DNAts DNAts DNAts OxyGs OxyAs OxyG |
| 475 | 121116 | 121133 | GAAAATTACTT ACATAGC | ASO-0600 | OxyGs OxyAs OxyAs OxyAs DNAts DNAts DNAts DNAas DNAts DNAcs DNAts DNAts DNAas DNAcs DNAas OxyTs OxyAs OxyGs OxyMC |
| 476 | 121516 | 121535 | AGAAAATACTT ATGTTACAA | ASO-0601 | DNAas OxyAs OxyGs OxyAs DNAas DNAts DNAts DNAas DNAts DNAts DNAts DNAas OxyAs OxyA DNAts DNAts DNAgs DNAts DNAts OxyAs OxyMCs OxyAs OxyA |
| 477 | 121875 | 121892 | TAAGTTGGCAA GGGAAGG | ASO-0602 | OxyTs DNAas DNAas DNAgs DNAts DNAts DNAgs DNAgs OxyAs OxyAs OxyGs OxyG DNAgs DNAas DNAgs DNAgs OxyAs OxyAs OxyGs OxyG |
| 478 | 122048 | 122065 | GAGGATTTTGA GGAGAGT | ASO-0603 | OxyGs OxyAs DNAgs DNAgs DNAas DNAts DNAts DNAts DNAts DNAgs DNAas DNAgs DNAas OxyAs OxyGs OxyT |
| 479 | 122626 | 122644 | TAGTAAATTGT GAAAGCAG | ASO-0604 | OxyTs OxyAs OxyGs OxyTs DNAas DNAas DNAas DNAts DNAts DNAts DNAts DNAgs DNAts DNAts DNAgs DNAas DNAgs OxyMCs OxyAs OxyG |
| 480 | 122628 | 122644 | TAGTAAATTGT GAAAGC | ASO-0605 | OxyTs OxyAs OxyGs OxyTs DNAas DNAas DNAas DNAts DNAts DNAts DNAts DNAgs DNAts DNAts OxyAs OxyGs OxyMC |
| 481 | 123356 | 123373 | AGGTAGAATGC AGTTTGGA | ASO-0606 | OxyAs OxyGs DNAgs DNAts DNAas DNAgs DNAas DNAts DNAgs DNAts DNAts DNAgs DNAts DNAts DNAgs DNAas DNAts DNAas DNAgs OxyGs OxyA |
| 482 | 123540 | 123557 | GTTTGGAGAAT ATGAGCC | ASO-0038 | OxyTs OxyTs DNAts DNAgs DNAgs DNAas DNAgs OxyAs OxyGs OxyMCs OxyMC DNAts DNAts DNAgs DNAgs DNAas DNAcs DNAas OxyAs OxyMC |
| 483 | 123540 | 123556 | TTTGGAGAATA TGAGCC | ASO-0607 | OxyGs DNAts DNAts DNAts DNAts DNAgs DNAgs DNAas DNAgs DNAas DNAas DNAts DNAas OxyGs OxyMCs OxyMC |
| 484 | 123596 | 123614 | GAGAGAAAAA TTTGAGAG | ASO-0608 | OxyGs OxyAs OxyGs OxyAs DNAgs DNAas DNAas DNAas DNAas DNAas DNAts DNAts DNAts DNAts DNAgs DNAas DNAgs OxyAs OxyG |
| 485 | 124333 | 124351 | TTTGTTTTGGTT TGGGCAC | ASO-0609 | OxyTs OxyTs DNAts DNAgs DNAts DNAts DNAts DNAts DNAgs DNAgs DNAts DNAts DNAts DNAgs DNAgs DNAgs DNAcs OxyAs OxyMC |
| 486 | 124393 | 124411 | CCTGTGGTTTC ATTTGTAT | ASO-0610 | OxyMCs OxyMCs DNAts DNAgs DNAts DNAgs DNAgs DNAts DNAts DNAts DNAcs DNAas DNAts DNAts DNAts DNAgs DNAts OxyAs OxyT |
| 487 | 124655 | 124673 | AAGATTTGCTA AATGGATG | ASO-0611 | OxyAs OxyAs OxyGs OxyAs DNAts DNAts DNAts DNAgs DNAcs DNAts DNAas DNAas DNAts DNAgs DNAgs OxyAs OxyT |
| 488 | 124782 | 124800 | TTTATTTGTTTA TTCACAG | ASO-0612 | OxyTs OxyTs DNAts DNAas DNAts DNAts DNAts DNAgs DNAts DNAts DNAts DNAas DNAts DNAts DNAcs DNAas OxyAs OxyT |
| 489 | 125313 | 125331 | TCAAGGTACAG GCAAATT | ASO-0613 | OxyTs OxyMCs OxyAs OxyAs DNAgs DNAgs DNAts DNAas DNAcs DNAas DNAgs DNAgs DNAcs DNAas OxyAs OxyT |
| 490 | 125420 | 125438 | TCCTATCCTTA ATAATCTA | ASO-0614 | OxyTs OxyMCs OxyMCs DNAts DNAas DNAts DNAts DNAcs DNAcs DNAts DNAts DNAas OxyAs OxyT |
| 491 | 125906 | 125924 | CTGATTTTATAT | ASO- | OxyMCs OxyTs DNAgs DNAas DNAts DNAts DNAts DNAts DNAts DNAts DNAts DNAts DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 492 | 126160 | 126177 | TCCCAAC | 0615 | DNAts DNAts DNAcs DNAcs DNAas DNAas OxyAs OxyMC |
| 493 | 126189 | 126205 | TTGGTTTTAAT GGGTAAT | ASO-0616 | OxyTs OxyTs OxyGs OxyGs DNAts DNAts DNAts DNAas DNAas DNAts DNAgs DNAgs OxyTs OxyAs OxyAs OxyT |
| 494 | 126773 | 126792 | TGCTTATGCTT TCTAGT | ASO-0617 | OxyTs OxyGs DNAcs DNAts DNAts DNAts DNAas DNAts DNAgs DNAcs DNAts DNAts DNAts DNAts DNAcs DNAts DNAts OxyGs OxyT |
| 495 | 127216 | 127233 | TACAATCTGAC CTATGAGAA | ASO-0618 | OxyTs OxyAs OxyMCs DNAas DNAts DNAts DNAcs DNAts DNAgs DNAas DNAts DNAgs DNAas OxyGs OxyAs OxyA |
| 496 | 127432 | 127449 | CATCTATTTCTT GGGCAT | ASO-0619 | DNAcs DNAcs DNAts DNAts DNAgs DNAgs DNAas DNAts DNAts DNAts DNAts DNAcs DNAcs DNAts DNAts DNAts OxyMCs OxyAs OxyT |
| 497 | 127633 | 127651 | AATTTAATGAG GAGAGGG | ASO-0620 | OxyAs OxyAs OxyTs OxyTs DNAts DNAas DNAas DNAas DNAgs DNAas DNAgs DNAgs DNAgs DNAas OxyAs OxyGs OxyGs OxyG |
| 498 | 127916 | 127933 | TAGGTTCTGAC ATATTTAT | ASO-0621 | OxyTs OxyAs OxyGs DNAgs DNAts DNAts DNAts DNAts DNAts DNAts DNAcs DNAts DNAts DNAts OxyTs OxyAs OxyT |
| 499 | 128404 | 128423 | GAGAATGTCTT TACTTGC | ASO-0622 | OxyGs OxyAs OxyGs DNAas DNAas DNAas DNAts DNAts DNAcs DNAts DNAts DNAts DNAts DNAts DNAts DNAts OxyGs OxyMC |
| 500 | 128557 | 128576 | AAGCTGCATTC ATAGAGATC | ASO-0623 | OxyAs OxyAs DNAgs DNAas DNAas DNAts DNAgs DNAcs DNAas DNAas DNAts DNAas DNAgs DNAas DNAts DNAas DNAts DNAts OxyAs OxyT OxyMC |
| 501 | 128559 | 128578 | ATTAATATTTC AAAGGACA | ASO-0624 | OxyAs OxyTs OxyTs OxyAs DNAas DNAts DNAts DNAts DNAts DNAts DNAts DNAts DNAts DNAts DNAts DNAts DNAts DNAts OxyAs OxyMCs OxyAs OxyA |
| 502 | 128829 | 128847 | GTATTAATATTT TCAAAGGA | ASO-0039 | OxyGs OxyTs OxyAs DNAts DNAts DNAts DNAts DNAts DNAts DNAcs DNAas DNAas OxyGs OxyGs OxyA |
| 503 | 129156 | 129173 | TATATTAGAAAA TTTGCAA | ASO-0625 | OxyTs OxyAs OxyTs DNAts DNAts OxyGs OxyMCs DNAts DNAas DNAts DNAts DNAts DNAas DNAas OxyAs OxyA |
| 504 | 129384 | 129402 | TGGTTTCAAAG TCTATAG | ASO-0626 | OxyTs OxyGs OxyGs OxyTs DNAts DNAts DNAts DNAas DNAas DNAts OxyAs OxyG |
| 505 | 129928 | 129944 | GTGTGTGTATT ATTTGATT | ASO-0627 | OxyGs OxyTs OxyGs OxyTs DNAgs DNAts DNAgs DNAas DNAas OxyTs OxyT |
| 506 | 129929 | 129946 | GAAACAGTATT ATGTAG | ASO-0628 | OxyGs OxyAs OxyAs OxyAs DNAts DNAts DNAgs DNAts DNAts DNAts OxyAs OxyG |
| 507 | 130403 | 130419 | TTGAAACAGTA TTATGTA | ASO-0629 | OxyTs OxyTs OxyGs OxyAs OxyAs DNAts DNAcs DNAts DNAgs DNAts DNAts OxyGs OxyTs OxyA |
| 508 | 130404 | 130420 | TAGTGATTTTG TGAGT | ASO-0630 | OxyTs OxyGs DNAts DNAgs OxyAs OxyGs OxyTs OxyT |
| 509 | 130875 | 130892 | CTAGTGATTTT GTGAGT | ASO-0631 | OxyMCs OxyTs OxyAs DNAgs DNAts DNAgs DNAts DNAts DNAts DNAts DNAts DNAts OxyGs OxyT |
| 510 | 131610 | 131629 | AGAAACAATT ACAATCC | ASO-0632 | OxyAs OxyGs OxyAs OxyAs DNAas DNAcs DNAas DNAas DNAts DNAts OxyAs OxyMCs OxyMC |
|  |  |  | TTTCTACTTTGT | ASO- | OxyTs OxyTs OxyTs OxyMCs DNAts DNAas DNAts DNAts DNAgs DNAts DNAts DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 511 | 131832 | 131851 | TCATTCAT | 0633 | DNAts DNAts DNAcs DNAas DNAts DNAts DNAcs OxyAs OxyT |
| 528 | 132531 | 132549 | CTAATTCAAAT CACTATACT | ASO-0634 | OxyMCs OxyTs OxyAs DNAas DNAts DNAts DNAcs DNAas DNAts DNAas DNAts DNAas DNAts DNAas OxyTs OxyAs OxyMCs OxyT |
| 529 | 132640 | 132657 | ATTAACTGACA AAAGGTAA | ASO-0667 | OxyAs OxyTs OxyTs OxyAs DNAas DNAts DNAgs DNAas OxyAs OxyA DNAas DNAas DNAas DNAgs OxyGs OxyTs OxyAs OxyA |
| 530 | 132771 | 132790 | AGAAGCTAAGG TAATAAC | ASO-0668 | OxyAs OxyGs OxyAs DNAgs DNAas DNAts DNAas DNAgs DNAas DNAts DNAas OxyTs OxyAs OxyAs OxyMC |
| 531 | 133229 | 133245 | AATAATGAGGA AGAAACTGT | ASO-0669 | OxyAs OxyAs OxyTs OxyAs DNAas DNAts DNAgs DNAas DNAgs DNAas DNAgs DNAas DNAas DNAas OxyMCs OxyTs OxyGs OxyT |
| 532 | 133232 | 133250 | GTCTTGTATTAT GTAAT | ASO-0670 | OxyGs OxyTs OxyMCs OxyTs DNAts DNAgs DNAts DNAas DNAts DNAts DNAas DNAts OxyAs OxyAs OxyT |
| 533 | 133234 | 133251 | AGAAAGTCTTG TATTATGT | ASO-1807 | OxyAs OxyGs OxyAs DNAas DNAas DNAgs DNAts DNAcs DNAts DNAts DNAas OxyAs OxyTs OxyGs OxyT |
| 534 | 133897 | 133914 | AAGAAAGTCTT GTATTAT | ASO-0671 | OxyAs OxyAs OxyAs OxyGs DNAas DNAts DNAts OxyTs OxyTs OxyAs OxyT |
| 535 | 134184 | 134201 | TAATTATATTTG TCTGCT | ASO-0672 | OxyTs OxyAs OxyAs OxyTs DNAts DNAas DNAts DNAts DNAas DNAts OxyGs OxyMCs OxyT |
| 536 | 134612 | 134629 | GATGGTGAAAA GGGCATT | ASO-0673 | OxyGs OxyAs DNAts DNAgs DNAgs DNAgs DNAts DNAgs DNAas OxyMCs OxyAs OxyTs OxyT |
| 537 | 135040 | 135057 | ATTTTGGACTT CTTAATA | ASO-0674 | OxyAs OxyTs OxyTs OxyTs DNAts DNAgs DNAgs DNAas DNAas DNAts DNAts DNAas DNAas DNAts OxyAs OxyT OxyA |
| 538 | 137687 | 137704 | AGAAGGGCAAT TTAATTT | ASO-0675 | OxyAs OxyGs OxyAs OxyAs DNAgs DNAgs DNAgs DNAas DNAts DNAts DNAts OxyAs OxyAs OxyTs OxyT |
| 539 | 137765 | 137784 | TATGTAACAGG TAAAGAA | ASO-0676 | OxyTs OxyAs OxyAs OxyTs DNAgs DNAts DNAas DNAas OxyGs OxyAs OxyA |
| 540 | 137766 | 137785 | GTAAATTTAAG GAAAATAGG | ASO-0040 | OxyGs OxyTs OxyAs OxyAs DNAas DNAts DNAts DNAas DNAas OxyTs OxyAs OxyGs OxyG |
| 541 | 138145 | 138164 | AGTAAATTTAA GGAAAATAG | ASO-0677 | OxyAs OxyGs OxyTs OxyAs DNAas DNAas DNAas DNAts DNAts DNAas DNAas OxyTs OxyAs OxyG |
| 542 | 138583 | 138602 | TATGTTTTAATT AGTAAATA | ASO-0678 | OxyTs OxyAs OxyGs OxyTs OxyAs DNAas DNAas DNAts DNAts DNAas DNAas OxyTs OxyA |
| 543 | 138827 | 138845 | AATAAGTAATA ATGACTACA | ASO-0679 | OxyAs OxyAs OxyTs OxyAs DNAas DNAts DNAas DNAts DNAas DNAgs DNAas OxyMCs OxyA |
| 544 | 139004 | 139021 | TGGATTAAGAA AACTGATG | ASO-0680 | OxyTs OxyGs OxyGs OxyAs DNAts DNAts DNAas DNAgs DNAas OxyGs OxyAs OxyTs OxyG |
| 545 | 139581 | 139600 | TTATTTGCTATT GATTAG | ASO-0681 | OxyTs OxyTs OxyAs OxyTs DNAts DNAgs DNAts DNAas DNAas OxyTs OxyAs OxyG |
|  |  |  | TTTTATACCAGT | ASO- | OxyTs DNAts DNAts DNAas DNAas DNAts DNAcs DNAcs DNAas DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 546 | 1339584 | 139600 | AAACCAGG | ASO-0682 | DNAts DNAas DNAas DNAcs DNAas DNAcs OxyAs OxyGs OxyG |
| 547 | 1339987 | 140005 | TTTTATACCAGTAAACC | ASO-0683 | OxyTs OxyTs OxyTs DNAas DNAts DNAas DNAcs DNAas DNAgs DNAts DNAas OxyAs OxyAs OxyMCs OxyMC |
| 548 | 140122 | 140139 | GTTTTAACTAAATGAACTA | ASO-0684 | OxyGs OxyTs OxyTs DNAts DNAas DNAas OxyAs OxyMCs OxyTs OxyA |
| 549 | 140637 | 140654 | TCTGGATTATTGGCTTTG | ASO-0685 | OxyTs OxyMCs DNAts DNAgs DNAgs DNAas DNAts DNAts OxyTs OxyTs OxyG |
| 550 | 140777 | 140794 | TAATTAAGTTTTCTTCCT | ASO-0686 | OxyTs OxyAs OxyAs OxyTs DNAts DNAas DNAas DNAgs DNAts DNAas DNAts DNAts DNAts DNAcs DNAts OxyMCs OxyT |
| 551 | 140877 | 141093 | CTTGTGATTTTAAGTGTT | ASO-0687 | OxyMCs OxyTs OxyTs DNAgs DNAas DNAas DNAts DNAts DNAts DNAts OxyGs OxyTs OxyT |
| 552 | 141074 | 141474 | TTTAAGAACCAAATTTAAGA | ASO-0688 | OxyTs OxyTs OxyTs DNAas DNAgs DNAas DNAts DNAts OxyAs OxyAs OxyGs OxyA |
| 553 | 141457 | 141783 | AGTTATTCAAATTGCTTA | ASO-0689 | OxyAs OxyGs OxyTs DNAts DNAas DNAts DNAas DNAas DNAts DNAcs DNAas DNAts OxyTs OxyA |
| 554 | 141767 | 142050 | AGGAGGTGTTAACTATG | ASO-0690 | OxyAs OxyGs DNAgs DNAas DNAgs DNAgs DNAts DNAgs DNAts DNAas DNAas OxyTs OxyAs OxyTs OxyG |
| 555 | 142032 | 142059 | TAAGATTGCTGAAAGAGAG | ASO-0041 | OxyTs OxyAs OxyAs DNAgs DNAas DNAts DNAts DNAas DNAgs OxyAs OxyAs OxyG |
| 556 | 142043 | 142618 | AGTAGAGGGTAAGATTG | ASO-0691 | OxyAs OxyGs OxyTs DNAas DNAgs DNAas DNAgs DNAgs DNAas OxyTs OxyTs OxyG |
| 557 | 142601 | 142955 | ATTTCTGTGTTTCTACCC | ASO-0692 | OxyAs DNAts DNAcs DNAts DNAas DNAcs DNAgs OxyMCs OxyMC |
| 558 | 142938 | 143377 | AGGAAGTTATAATGAATG | ASO-0693 | OxyAs OxyGs OxyGs DNAas DNAas DNAts DNAts DNAas OxyAs OxyAs OxyTs OxyG |
| 559 | 143358 | 143527 | TGTGAGTTTAAAATCCTAAT | ASO-0694 | OxyTs OxyGs OxyTs OxyGs DNAas DNAts DNAts DNAcs DNAts OxyAs OxyAs OxyT |
| 560 | 143511 | 143847 | TTTGTAACTTACTACCA | ASO-0695 | OxyTs OxyTs OxyGs DNAts DNAas DNAas DNAcs DNAts DNAts DNAas OxyA |
| 561 | 143828 | 144059 | TTACATTTCTACATTCCTGG | ASO-0696 | OxyTs DNAts DNAas DNAcs DNAas DNAts DNAts DNAcs DNAcs DNAts OxyGs OxyG |
| 562 | 144042 | 144422 | ATTAAAAGGTAACTATTGC | ASO-0697 | OxyAs OxyTs OxyTs DNAas DNAas DNAgs DNAgs OxyAs OxyAs OxyGs OxyMC |
| 563 | 144407 | 144889 | GTCTATCTTACTGTAC | ASO-0698 | OxyGs OxyTs OxyMCs OxyTs DNAts DNAts DNAgs OxyTs OxyAs OxyMC |
| 564 | 144870 | 145107 | TATCATTTGTTTATGAATT | ASO-0699 | OxyTs OxyAs OxyTs OxyMCs DNAas DNAts DNAts DNAas DNAgs OxyAs OxyAs OxyTs OxyT |
| | 145090 | | ATAGATTTTAGT | ASO- | OxyAs OxyTs OxyAs OxyGs DNAas DNAts DNAts DNAts DNAts DNAas DNAgs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 565 | 145328 | 145344 | AATATCT AGTGGGAGATA TGATCA | ASO-0700 | DNAas DNAts OxyAs OxyTs OxyMCs OxyT |
| 566 | 145632 | 145649 | AAAGAAAGTTA CTGGATC | ASO-0701 | OxyAs OxyGs OxyTs DNAgs DNAas DNAgs DNAags DNAas DNAts DNAts DNAas OxyTs OxyA |
| 567 | 146064 | 146081 | TGGGAGTTTGA TTAGCTG | ASO-0702 | OxyAs OxyAs OxyGs DNAas DNAas DNAts DNAts DNAas OxyTs OxyMC |
| 568 | 146200 | 146217 | GAATAGAAATA TAGACAG | ASO-0703 | OxyTs OxyGs DNAgs DNAgs DNAas DNAgs OxyMCs OxyTs OxyG |
| 569 | 146424 | 146443 | AAAGCACTGAA AACTAAGTT | ASO-0704 | DNAts DNAas DNAgs DNAgs OxyAs OxyMCs OxyAs OxyG |
| 570 | 146833 | 146849 | GTAGTTGGATT TGGTTC | ASO-0705 | OxyAs OxyAs OxyAs OxyGs DNAas DNAas DNAts DNAas DNAgs DNAas DNAts DNAas DNAas OxyAs OxyGs OxyT |
| 571 | 146843 | 146860 | CAAAGATTGAG GTAGTTG | ASO-0706 | OxyGs DNAts DNAas DNAgs OxyGs OxyTs OxyMC |
| 572 | 146922 | 146938 | AATCATTGTTT GTCAGC | ASO-0042 | OxyMCs OxyAs OxyAs OxyAs DNAgs DNAas DNAts DNAgs DNAas DNAgs OxyTs OxyG |
| 573 | 147960 | 147978 | GAGTAGGAAAA TTAAACTC | ASO-0707 | OxyAs OxyAs OxyTs OxyMCs DNAas DNAts DNAts DNAts DNAgs DNAas OxyAs OxyGs OxyMC |
| 574 | 148347 | 148364 | GCTATAATTTT GAGGGTA | ASO-0708 | OxyGs OxyAs OxyGs OxyTs DNAas DNAas DNAas OxyAs OxyMCs OxyTs OxyMC |
| 575 | 148501 | 148518 | TTTGTCAGGGT AAAATAA | ASO-0709 | OxyGs OxyMCs DNAts DNAas DNAgs DNAgs OxyGs OxyTs OxyA |
| 576 | 149240 | 149258 | ATAATACATTTT GGCAGTC | ASO-0710 | OxyTs OxyTs OxyTs OxyGs DNAts DNAas DNAas OxyTs OxyAs OxyA |
| 577 | 149261 | 149279 | AAACATTTGAG AAAACAGG | ASO-0711 | OxyAs OxyTs OxyAs OxyAs DNAts DNAas DNAcs OxyGs OxyTs OxyMC |
| 578 | 149892 | 149910 | TTCCACTCTCT TATTTTAA | ASO-0712 | OxyAs OxyAs OxyAs OxyMCs DNAas DNAts DNAts DNAts DNAgs DNAas OxyAs OxyGs OxyG |
| 579 | 150255 | 150272 | TCCATTCACTT ATTAATA | ASO-0713 | OxyTs OxyTs OxyMCs OxyMCs DNAas DNAts DNAts DNAts DNAgs DNAas DNAcs DNAts |
| 580 | 150696 | 150713 | AAAGAGTTTGG TTTGATG | ASO-0714 | OxyTs OxyMCs OxyMCs DNAas DNAts DNAts OxyTs OxyAs OxyA |
| 581 | 151007 | 151026 | ATATTTTATAAG TCTTGCAT | ASO-0715 | OxyAs OxyAs OxyTs OxyMCs DNAas DNAts DNAts DNAas DNAcs DNAts |
| 582 | 151090 | 151109 | ATATTTTATCTT TATTTACT | ASO-0716 | OxyAs OxyTs OxyTs OxyAs DNAas DNAts DNAgs OxyMCs OxyAs OxyA |
| 583 | 151379 | 151398 | CTTTATCATCTA | ASO-0717 | OxyAs OxyTs OxyAs OxyTs DNAts DNAts DNAts DNAts DNAas DNAcs DNAts DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 584 | 151387 | 151404 | ATTCCATC | 0043 | DNAas DNAas DNAts DNAts DNAcs OxyMCs OxyAs OxyTs OxyMC |
| 585 | 151841 | 151859 | TCTGTGCTTTA TCATCTA | ASO-0718 | OxyTs OxyMCs DNAts DNAgs DNAas DNAts DNAts DNAts DNAas DNAts DNAcs DNAas DNAts DNAcs OxyTs OxyA |
| 586 | 151842 | 151860 | TTTTAGCTTCA GGTGTACA | ASO-0719 | OxyTs OxyTs DNAts DNAts DNAas DNAgs DNAcs DNAts DNAts DNAcs DNAgs DNAts DNAts OxyAs OxyMCs OxyA |
| 587 | 152436 | 152455 | ATTTTAGCTTCA GGTGTAC | ASO-0720 | OxyAs DNAts DNAts DNAts DNAts DNAas DNAgs DNAts DNAts DNAcs DNAts DNAts DNAts OxyGs OxyTs OxyAs OxyMC |
| 588 | 152678 | 152697 | TGGTTGAGATT AAATGAGAT | ASO-0721 | OxyTs OxyGs DNAgs DNAts DNAts DNAts DNAgs DNAas DNAgs DNAas OxyGs OxyAs OxyT |
| 589 | 152683 | 152700 | ATTGTGTTATA CCTATTCCA | ASO-0722 | OxyAs DNAts DNAts DNAts DNAts DNAgs DNAts DNAts DNAas DNAts DNAas DNAts OxyMCs OxyA |
| 590 | 152708 | 152726 | AAAATTGTGTT ATACCTA | ASO-0723 | OxyAs OxyAs OxyAs DNAts DNAas DNAas DNAgs DNAts DNAgs DNAts DNAts OxyMCs OxyTs OxyA |
| 591 | 152709 | 152726 | TCGCACTAGAA AAAATAA | ASO-0724 | OxyTs OxyMCs OxyGs OxyMCs DNAas DNAas DNAts DNAas DNAgs DNAas DNAas DNAas OxyA |
| 592 | 152709 | 152727 | TCGCACTAGAA AAAATA | ASO-0725 | OxyTs OxyMCs OxyGs OxyMCs DNAas DNAas DNAas DNAts DNAas DNAgs DNAas OxyTs OxyAs OxyTs OxyA |
| 593 | 152709 | 152728 | GTCGCACTAGA AAAAATA | ASO-0726 | OxyGs OxyTs OxyMCs OxyGs OxyMCs DNAas DNAas DNAas DNAts DNAas DNAgs DNAas OxyAs OxyTs OxyA |
| 594 | 152712 | 152731 | AGTCGCACTAG AAAAAATA | ASO-0727 | OxyAs OxyGs OxyTs OxyMCs OxyGs OxyMCs DNAas DNAas DNAgs DNAas DNAas DNAas OxyAs OxyAs OxyTs OxyA |
| 595 | 152713 | 152731 | TGAAGTCGCAC TAGAAAAA | ASO-0728 | OxyTs OxyGs OxyAs OxyAs OxyGs DNAgs DNAas DNAas DNAas DNAmcs DNAcs DNAas OxyAs OxyAs OxyA |
| 596 | 152713 | 152732 | TGAAGTCGCAC TAGAAAA | ASO-0729 | OxyTs OxyGs OxyAs OxyAs OxyGs DNAgs DNAas DNAas DNAcs DNAas OxyAs OxyAs OxyA |
| 597 | 152714 | 152731 | ATGAAGTCGCA CTAGAAAAA | ASO-0730 | OxyAs OxyTs OxyGs OxyAs OxyAs OxyGs DNAgs DNAas DNAas DNAmcs DNAcs DNAas OxyAs OxyAs OxyA |
| 598 | 152714 | 152732 | TGAAGTCGCAC TAGAAAA | ASO-0731 | OxyTs OxyGs OxyAs OxyAs OxyGs OxyAs DNAgs DNAas DNAas DNAmcs DNAcs DNAas OxyAs OxyAs OxyA |
| 599 | 152714 | 152733 | ATGAAGTCGCA CTAGAAAA | ASO-0732 | OxyAs OxyTs OxyGs OxyAs OxyAs OxyGs DNAts DNAas DNAas DNAmcs DNAcs DNAas OxyAs OxyAs OxyA |
| 600 | 152715 | 152730 | CATGAAGTCGC ACTAGAAAA | ASO-0733 | OxyMCs OxyAs OxyTs OxyGs OxyAs OxyAs DNAts DNAas DNAas DNAmcs DNAcs DNAas OxyAs OxyAs OxyA |
| 601 | 152715 | 152731 | GAAGTCGCACT AGAAA | ASO-0734 | OxyGs OxyAs OxyAs OxyGs OxyTs DNAts DNAas DNAas DNAmcs DNAcs DNAas OxyAs OxyA |
| 602 | 152715 | 152732 | TGAAGTCGCAC TAGAAA | ASO-0735 | OxyTs OxyGs OxyAs OxyAs OxyGs DNAts DNAas DNAas DNAts DNAmcs DNAgs DNAcs DNAas OxyGs OxyAs OxyA |
| | | | ATGAAGTCGCA | ASO- | OxyAs OxyTs OxyGs OxyAs OxyAs DNAas DNAgs DNAts DNAmcs DNAgs DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 603 | 152715 | 152733 | CTAGAAA CATGAAGTCGC ACTAGAAA | ASO-0736 ASO-0737 | DNAas DNAcs DNAts DNAas OxyGs OxyAs OxyA OxyMCs OxyAs OxyTs DNAgs DNAas DNAgs DNAts DNAmcs DNAgs DNAcs DNAas DNAts DNAas OxyGs OxyAs OxyA |
| 604 | 152716 | 152731 | TGAAGTCGCAC TAGAA | ASO-0738 | OxyTs OxyGs OxyAs OxyAs DNAgs DNAts DNAmcs DNAgs DNAcs DNAas DNAcs DNAts DNAas OxyGs OxyAs OxyA |
| 605 | 152716 | 152732 | ATGAAGTCGCA CTAGAA | ASO-0739 | OxyAs OxyTs OxyGs OxyAs DNAas DNAgs DNAts DNAmcs DNAgs DNAcs DNAas DNAts DNAas OxyGs OxyAs OxyA |
| 606 | 152716 | 152733 | CATGAAGTCGC ACTAGAA | ASO-0740 | OxyMCs OxyAs OxyTs DNAgs DNAas DNAgs DNAts DNAmcs DNAgs DNAcs DNAas DNAcs DNAts DNAas OxyGs OxyAs OxyA |
| 607 | 152760 | 152777 | CAAATCAAACA CCAAGTA | ASO-0741 | OxyMCs OxyAs OxyAs OxyAs DNAts DNAcs DNAas DNAas DNAas OxyAs OxyGs OxyTs OxyA |
| 608 | 152760 | 152778 | ACAAATCAAAC ACCAAGTA | ASO-0742 | OxyAs OxyMCs OxyAs OxyAs OxyAs DNAaas DNAas DNAas DNAcs DNAaas DNAas OxyGs OxyTs OxyA |
| 609 | 152761 | 152779 | TACAAATCAAA CACCAAGT | ASO-0743 | OxyTs OxyAs OxyMCs OxyAs DNAaas DNAcs DNAaas DNAcs DNAas OxyAs OxyAs OxyGs OxyT |
| 610 | 152761 | 152780 | TTACAAATCAA ACACCAAGT | ASO-0744 | OxyTs OxyTs OxyAs OxyMCs DNAaas DNAcs DNAas DNAcs DNAas OxyAs OxyGs OxyT |
| 611 | 152763 | 152782 | ACTTACAAATC AAACACCAA | ASO-0745 | OxyAs OxyMCs DNAts DNAts DNAas DNAas DNAcs DNAas OxyMCs OxyAs OxyMCs OxyAs OxyA |
| 612 | 152764 | 152782 | ACTTACAAATC AAACACCA | ASO-0746 | OxyAs OxyMCs DNAts DNAts DNAas DNAas DNAcs DNAas OxyAs OxyMCs OxyMCs OxyA |
| 613 | 152764 | 152783 | TACTTACAAAT CAAACACCA | ASO-0747 | OxyTs OxyAs OxyMCs DNAts DNAts DNAas DNAaas DNAcs DNAas OxyAs OxyMCs OxyMCs OxyA |
| 614 | 152765 | 152782 | ACTTACAAATC AAACACC | ASO-0748 | OxyAs OxyMCs OxyTs DNAts DNAas DNAas DNAcs DNAas OxyAs OxyMCs OxyMC |
| 615 | 152765 | 152783 | TACTTACAAAT CAAACACC | ASO-0749 | OxyTs OxyAs OxyMCs OxyAs DNAts DNAas DNAas DNAcs DNAas OxyAs OxyMCs OxyMC |
| 616 | 152765 | 152784 | ATACTTACAAA TCAAACACC | ASO-0750 | OxyAs OxyTs OxyAs OxyMCs DNAts DNAas DNAas DNAcs DNAas OxyAs OxyMCs OxyMC |
| 617 | 152766 | 152783 | TACTTACAAAT CAAACAC | ASO-0751 | OxyTs OxyAs OxyMCs OxyTs DNAts DNAas DNAas DNAcs DNAas OxyAs OxyMCs OxyMC |
| 618 | 152766 | 152784 | ATACTTACAAA TCAAACAC | ASO-0752 | OxyAs OxyTs OxyAs OxyMCs DNAts DNAas DNAas DNAcs DNAas OxyAs OxyMCs OxyMC |
| 619 | 152766 | 152785 | TATACTTACAA ATCAAACAC | ASO-0753 | OxyTs OxyTs OxyAs OxyAs DNAcs DNAts DNAas DNAas OxyMCs DNAcs DNAaas DNAas OxyMCs |
| 620 | 152767 | 152785 | TATACTTACAA ATCAAACA | ASO-0754 | OxyTs OxyAs OxyTs OxyAs OxyAs DNAts DNAcs DNAts DNAas DNAcs DNAas OxyMCs OxyA |
| 621 | 152767 | 152786 | ATATACTTACAA | ASO- | OxyAs OxyTs OxyAs OxyTs DNAaas DNAcs DNAts DNAas DNAcs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 622 | 153220 | 153238 | ATCAAACA TTCATT | ASO-0755 | DNAas DNAas DNAcs DNAas OxyAs DNAts DNAcs OxyMCs OxyA |
| 623 | 153520 | 153536 | CATTATTTCCC TTCATTC | ASO-0756 | OxyMCs OxyAs DNAts DNAcs DNAas DNAts DNAts DNAts DNAcs DNAts DNAcs DNAts DNAcs OxyTs OxyMC |
| 624 | 153964 | 153983 | TTCTCTATAATT GGATC | ASO-0757 | OxyTs OxyTs OxyMCs OxyTs DNAcs DNAts DNAas DNAts DNAas DNAts DNAts DNAts DNAcs OxyTs OxyMC |
| 625 | 153969 | 153985 | AGTTGTAATTT CATTCCCTT | ASO-0758 | OxyAs DNAgs DNAts DNAts DNAgs DNAas DNAts DNAas DNAas DNAcs DNAas OxyMCs OxyTs OxyT |
| 626 | 154743 | 154761 | CCAGTTGTAAT TTCATT | ASO-0759 | DNAcs DNAas DNAts DNAts DNAcs DNAcs OxyGs DNAts DNAts DNAgs DNAts DNAas DNAas DNAts DNAcs DNAas OxyAs OxyTs OxyT |
| 627 | 154745 | 154761 | TCAAACATTGG AAAGGAAG | ASO-0760 | OxyTs OxyMCs OxyAs OxyAs DNAas DNAcs DNAas DNAts DNAts DNAgs DNAgs DNAas DNAas DNAgs OxyGs OxyAs OxyG |
| 628 | 155365 | 155384 | TCAAACATTGG AAAGGA | ASO-0761 | OxyTs OxyMCs OxyAs OxyAs DNAas DNAcs DNAas DNAts DNAts DNAgs DNAgs OxyGs OxyA |
| 629 | 155396 | 155415 | GACAGAACAAT AATAAATTA | ASO-0762 | OxyGs OxyAs OxyMCs OxyAs DNAgs DNAas DNAts DNAas DNAas OxyAs OxyTs OxyA |
| 630 | 155941 | 155959 | CAGAGGAAAGA ATTAGACAA | ASO-0763 | OxyMCs OxyAs OxyGs OxyAs DNAgs DNAas DNAgs OxyAs OxyMCs OxyAs OxyA |
| 631 | 155942 | 155960 | AGATAATCAAC AGGCAGCA | ASO-0764 | OxyAs DNAgs DNAas DNAgs DNAas DNAcs DNAas DNAgs DNAts DNAas OxyGs OxyMCs OxyA |
| 632 | 155943 | 155959 | AAGATAATCAA CAGGCAGC | ASO-0765 | OxyAs DNAas DNAas DNAts DNAas DNAts DNAcs DNAas DNAcs DNAas DNAgs OxyMCs OxyAs OxyGs OxyMC |
| 633 | 156515 | 156532 | AGATAATCAAC AGGCAG | ASO-0766 | OxyAs OxyGs DNAgs DNAts DNAas DNAts DNAcs DNAas DNAas OxyMCs OxyAs OxyG |
| 634 | 156666 | 156682 | GTTAATCTCTC TCTTGTT | ASO-0767 | OxyGs OxyTs DNAas DNAts DNAcs DNAts DNAcs DNAts DNAcs DNAts DNAcs DNAts DNAcs DNAts DNAas DNAts DNAcs OxyT |
| 635 | 157021 | 157039 | TTTCCATAAGT CAATTC | ASO-0768 | OxyTs OxyTs OxyTs OxyMCs DNAcs DNAas OxyAs OxyTs OxyTs OxyMC |
| 636 | 157447 | 157465 | ATGACTGTGAA AACTGGC | ASO-0769 | OxyAs DNAts DNAgs DNAas DNAcs DNAts DNAgs DNAts DNAgs DNAas DNAas DNAas DNAcs DNAts DNAgs OxyGs DNAts |
| 637 | 157735 | 157753 | TTTATTAATCTC ATTTACT | ASO-0770 | OxyTs OxyTs DNAts DNAas DNAts DNAts DNAas DNAas DNAts DNAcs DNAts DNAas DNAts DNAts DNAts DNAcs OxyT |
| 638 | 157739 | 157756 | CAAGTAGTTAT TTTATCTC | ASO-0771 | OxyMCs OxyAs OxyAs DNAgs DNAts DNAas DNAgs DNAts DNAts DNAat DNAts DNAts DNAts DNAas DNAts DNAcs OxyMC |
| 639 | 159291 | 159308 | ATTCAAGTAGT TATTTTA | ASO-0772 | OxyAs OxyTs OxyTs OxyMCs DNAas DNAas DNAgs DNAts DNAas DNAgs DNAts DNAts DNAas DNAts DNAcs OxyA |
| 640 | 159834 | 159851 | CAATTTGCTGT TCCTATA | ASO- | OxyAs OxyMCs OxyAs DNAts DNAts DNAts DNAgs DNAcs DNAts DNAgs DNAts DNAts DNAcs DNAcs DNAts DNAat DNAts DNAat DNAas OxyA |
| | | | ACACTATTTTA | | OxyAs OxyMCs OxyMCs OxyAs DNAts DNAas DNAas DNAts DNAas DNAts DNAts DNAts DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 641 | 159871 | 159887 | GTTCTTT CTCAGCTATGT | ASO-0773 | DNAas DNAgs DNAts DNAts OxyMCs OxyTs OxyT |
| 642 | 160252 | 160269 | CTCAGCTATGT TCTATA | ASO-0774 | OxyMCs OxyTs DNAas DNAcs DNAts DNAts DNAgs DNAts DNAts DNAcs OxyTs OxyTs OxyA |
| 643 | 160665 | 160684 | TTTTATGTAGAT TAACTG | ASO-0775 | OxyTs OxyTs OxyTs OxyTs DNAas DNAts DNAgs DNAts DNAas DNAgs DNAas DNAts DNAts DNAas OxyAs OxyMCs OxyTs OxyG |
| 644 | 160668 | 160684 | TAATCGTGTAT TTTGCCTTC | ASO-0776 | OxyTs OxyAs OxyAs DNAts DNAats DNAgs DNAts DNAgs DNAts DNAas DNAcs DNAcs DNAts OxyTs OxyMC |
| 645 | 160668 | 160685 | TTAATCGTGTA TTTTGCC | ASO-0045 | OxyTs DNAts DNAas DNAas DNAts DNAts OxyT OxyGs OxyMCs OxyMC |
| 645 | 160671 | 160687 | AGTTAATCGTG TATTTT | ASO-0777 | DNAas DNAts DNAts DNAts OxyTs DNAas DNAts DNAmcs DNAgs DNAts DNAgs DNAts DNAas OxyTs OxyTs OxyT |
| 646 | 161777 | 161794 | TAAGGAGGACA GAACAGG | ASO-0778 | OxyTs OxyAs OxyAs DNAgs DNAas DNAgs DNAgs DNAas DNAcs DNAas DNAas OxyAs OxyGs OxyG |
| 647 | 161877 | 161895 | ATCTAAAAGGT TATATACT | ASO-0779 | OxyAs OxyTs OxyMCs OxyTs DNAas DNAas DNAts DNAas OxyTs OxyAs OxyMCs OxyT |
| 648 | 162407 | 162424 | AGGAAATAAGC TATAAGG | ASO-0780 | OxyAs OxyGs OxyGs OxyAs DNAas DNAts DNAts OxyAs OxyAs OxyGs OxyG |
| 649 | 162720 | 162737 | GCTATGGAGAC AGTATGG | ASO-0781 | OxyGs OxyMCs DNAts DNAas DNAgs DNAgs DNAts DNAas DNAts OxyGs OxyG |
| 650 | 162730 | 162747 | CAAAGGTAAAG CTATGGA | ASO-0782 | OxyMCs OxyAs OxyAs OxyAs DNAgs DNAgs DNAts DNAas OxyTs OxyGs OxyGs OxyA |
| 651 | 163806 | 163825 | TAGAAGACTGA CACTACTCA | ASO-0783 | OxyTs OxyAs DNAgs DNAas DNAas DNAgs DNAas DNAcs DNAts OxyMCs DNAts OxyA |
| 652 | 163809 | 163827 | GATAGAAGACT GACACTAC | ASO-0046 | OxyGs OxyAs DNAts DNAas DNAgs OxyMCs DNAgs OxyAs OxyMC |
| 653 | 163811 | 163827 | GATAGAAGACT GACACT | ASO-0784 | DNAgs DNAas OxyMCs DNAgs DNAas DNAgs OxyMCs OxyAs OxyMCs OxyT |
| 654 | 164061 | 164078 | AGTTATTTATTG GTTTAA | ASO-0785 | OxyAs OxyGs OxyTs OxyTs DNAas DNAts DNAts DNAts DNAgs DNAas DNAts DNAas |
| 655 | 164362 | 164380 | CTTAAGGAAAT GTTATAAC | ASO-0786 | OxyMCs OxyTs OxyTs OxyAs DNAas DNAgs DNAgs DNAts DNAas OxyTs OxyAs OxyAs OxyMC |
| 656 | 165139 | 165156 | ATTGAGTACAG GCAGAGT | ASO-0787 | OxyAs DNAts DNAts DNAgs DNAas DNAgs DNAts DNAcs DNAas DNAgs OxyGs OxyT |
| 657 | 165142 | 165160 | ATTTATTGAGTA CAGGCAG | ASO-0788 | OxyAs OxyTs OxyTs DNAts DNAts DNAts DNAgs DNAas DNAgs DNAts DNAcs OxyAs OxyG |
| 658 | 165664 | 165682 | GTCTTCATGCT ATTTTCAC | ASO-0789 | OxyGs OxyTs OxyMCs DNAts DNAts DNAts DNAcs DNAas DNAts DNAcs DNAas OxyAs OxyMC |
| 659 | 166220 | 166239 | ATGGTCTATTA | ASO- | OxyAs OxyTs OxyGs DNAgs DNAts DNAcs DNAts DNAas DNAts DNAts DNAas DNAts DNAcs DNAs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 660 | 166409 | 166426 | AATGTGCAA AGCAGTGATAC AAGGGAC | ASO-0790 | DNAas DNAts DNAgs DNAts DNAgs OxyMCs OxyAs OxyA |
| 661 | 166738 | 166754 | GAGATTATCCT TCAAAT | ASO-0791 | OxyAs OxyGs OxyMCs DNAas DNAgs DNAts DNAgs DNAas DNAts DNAcs DNAts DNAgs OxyAs OxyMC |
| 662 | 167073 | 167090 | TGGGAATAGTG GAAGGAG | ASO-0792 | OxyGs OxyAs OxyGs DNAts DNAcs DNAts DNAcs DNAts DNAgs DNAts DNAcs DNAts DNAcs DNAts DNAgs OxyAs OxyT |
| 663 | 167365 | 167382 | GATGATGTAAA CAGAGAG | ASO-0793 | OxyTs DNAgs DNAgs DNAas DNAas DNAts DNAgs OxyGs OxyAs OxyG |
| 664 | 167371 | 167388 | CAGGTGGATGA TGTAAAC | ASO-0794 | DNAgs DNAgs DNAas DNAas OxyGs OxyAs OxyAs OxyG DNAcs DNAas DNAgs OxyAs OxyGs OxyAs OxyG |
| 665 | 168021 | 168040 | TATTGAAGGCT TATTTACCA | ASO-0795 | OxyMCs OxyAs OxyGs OxyGs DNAts DNAgs DNAgs DNAas DNAts DNAgs DNAts DNAas OxyAs OxyMC |
| 666 | 168023 | 168040 | TATTGAAGGCT TATTTAC | ASO-0796 | OxyTs DNAas DNAts DNAts DNAgs DNAgs DNAas OxyMCs OxyMCs OxyAs OxyA |
| 667 | 168468 | 168487 | TTTAACTGATG AATTGCTGA | ASO-0797 | OxyTs OxyAs DNAas DNAts DNAts DNAgs OxyTs OxyTs OxyAs OxyMC |
| 668 | 169122 | 169141 | CCTTGCTTGTA TTTTCAAAT | ASO-0798 | OxyTs DNAts DNAts DNAas DNAas DNAts DNAgs OxyMCs OxyTs OxyGs OxyA |
| 669 | 169402 | 169420 | TTTACATTTAAT TAACTTT | ASO-0799 | OxyMCs OxyMCs DNAts DNAts DNAts DNAts DNAcs DNAas DNAts DNAts DNAgs OxyAs OxyT |
| 670 | 169409 | 169427 | CCATGATTTTA CATTTAAT | ASO-0800 | OxyTs OxyTs OxyAs DNAcs DNAas DNAts DNAts DNAas DNAgs OxyTs OxyT |
| 671 | 169672 | 169689 | CTGGGAGATGA AATGGAT | ASO-0801 | OxyMCs OxyTs DNAgs DNAas DNAts DNAas DNAts OxyTs OxyAs OxyAs OxyT |
| 672 | 169826 | 169843 | AGAGAATGTCT AAAGTAC | ASO-0802 | OxyMCs DNAas DNAas DNAas DNAgs DNAas DNAgs OxyGs OxyAs OxyT |
| 673 | 170374 | 170391 | GATTTCTCTAA ATGTGTA | ASO-0803 | OxyAs OxyGs OxyAs DNAgs DNAas DNAts DNAts DNAcs DNAts DNAas DNAts DNAcs DNAts DNAgs OxyAs OxyMC |
| 674 | 170483 | 170501 | TTAATTACTCTC TAAACTT | ASO-0804 | OxyGs OxyAs DNAts DNAts DNAas OxyTs DNAcs DNAts DNAcs OxyTs OxyA |
| 675 | 170826 | 170843 | AAATCTGCTTG TTTGTCA | ASO-0805 | OxyTs OxyTs OxyAs OxyAs DNAts DNAts DNAcs DNAts DNAgs DNAts OxyMCs OxyT |
| 676 | 170995 | 171012 | GCTCAATAATT GCTTCTA | ASO-0806 | OxyAs OxyAs OxyTs DNAcs DNAts DNAts DNAas DNAts DNAcs DNAcs DNAts DNAas DNAts DNAgs OxyAs OxyA |
| 677 | 171616 | 171632 | TGATAGTATATT GGTTT | ASO-0807 | OxyGs OxyMCs DNAcs DNAts DNAts DNAts DNAts DNAts DNAcs DNAgs OxyAs OxyMCs DNAas DNAts DNAts OxyTs OxyT |
| 678 | 171755 | 171774 | TAAATGAATGT | ASO- | OxyTs OxyGs OxyAs OxyGs OxyTs DNAts DNAas DNAts DNAgs DNAts DNAgs DNAts DNAgs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 679 | 172117 | 172136 | AGAATCTTA | ASO-0808 | DNAas DNAgs DNAas DNAts DNAgs DNAts OxyMCs OxyTs OxyA |
| 680 | 172259 | 172275 | AGATGGAATAA TTTAAAGCC | ASO-0809 | OxyAs DNAgs DNAts DNAgs DNAgs DNAas DNAas DNAts DNAas DNAts DNAts DNAts OxyAs OxyGs OxyMCs OxyMC |
| 681 | 172675 | 172691 | GAACTGTTTTA GATATC | ASO-0810 | OxyGs OxyAs OxyAs OxyMCs DNAts DNAgs DNAts DNAts DNAts DNAas DNAgs DNAas OxyTs OxyAs OxyTs OxyMC |
| 682 | 173063 | 173080 | AGACTATATGA AGGTGA | ASO-0811 | OxyAs OxyGs OxyAs DNAcs DNAts DNAts DNAts DNAgs DNAts DNAas DNAgs OxyGs OxyTs OxyGs OxyA |
| 683 | 173092 | 173108 | ATAAATTAATTC ATGGTA | ASO-0812 | DNAcs DNAas DNAts OxyGs OxyGs OxyTs OxyA |
| 684 | 173465 | 173482 | ATAGTTGGTAA TATAGA | ASO-0813 | OxyAs OxyTs OxyAs OxyGs DNAts DNAgs DNAgs DNAts DNAas DNAas DNAts DNAas OxyTs OxyAs OxyGs OxyA |
| 685 | 173893 | 173911 | TTTCATTTCTTA AAACGT | ASO-0814 | OxyTs OxyTs OxyTs OxyMCs DNAas DNAts DNAts DNAts DNAcs DNAts DNAas DNAas OxyAs OxyMCs OxyGs OxyT |
| 686 | 173986 | 174004 | AGGGTTGAATA GTTTTCAG | ASO-0815 | OxyAs OxyGs OxyGs DNAgs DNAts DNAts DNAts DNAgs DNAaas DNAas DNAts DNAts DNAcs OxyAs OxyG |
| 687 | 173988 | 174004 | CAGATCAGTAG GTTTCTT | ASO-0048 | OxyMCs OxyAs DNAgs DNAas DNAts DNAts DNAcs DNAts DNAcs DNAgs DNAas OxyTs OxyTs OxyT |
| 688 | 174336 | 174352 | CAGATCAGTAG GTTTCT | ASO-0816 | OxyMCs OxyAs OxyGs DNAas DNAts DNAts DNAts DNAcs DNAts DNAts OxyMCs OxyT |
| 689 | 174679 | 174695 | CTGAAGGATTG AGGTTG | ASO-0817 | OxyMCs OxyTs OxyGs OxyAs DNAas DNAgs DNAgs DNAts DNAts OxyTs OxyG |
| 690 | 174862 | 174879 | TATATGCTTGT CAGTTT | ASO-0818 | OxyTs OxyAs OxyTs OxyAs DNAts DNAgs DNAcs DNAts DNAts DNAgs DNAts DNAas DNAas DNAgs OxyTs OxyT |
| 691 | 175112 | 175128 | TATTTTACAGTT GTTCAT | ASO-0819 | OxyTs OxyAs OxyTs OxyTs DNAts DNAts DNAts OxyMCs OxyAs OxyAs OxyT |
| 692 | 175638 | 175656 | GCTGGTTATAG TAATAA | ASO-0820 | DNAts DNAgs DNAts DNAas OxyAs OxyTs OxyAs OxyA |
| 693 | 175647 | 175663 | TGATGTAAGCC TGGAACTG | ASO-0821 | OxyTs OxyGs OxyAs OxyTs OxyGs DNAgs DNAts DNAts DNAas DNAgs DNAcs DNAcs DNAas DNAas OxyTs OxyG |
| 703 | 176315 | 176332 | GTAAGAATGAT GTAAGC | ASO-0822 | OxyGs OxyTs OxyAs OxyAs DNAas OxyGs OxyGs OxyAs OxyAs OxyGs OxyMC |
| 704 | 176730 | 176747 | ATGACTGAATT AAATATG | ASO-0842 | OxyAs OxyTs OxyGs OxyAs DNAas OxyAs OxyTs OxyG |
| 705 | 177165 | 177183 | GTGCATTAAAT TATCTAT | ASO-0843 | OxyGs OxyTs OxyGs OxyMCs DNAas DNAts DNAts DNAas DNAas OxyTs OxyAs OxyT |
| 706 | 177458 | 177477 | GCTACATATAA TGAGGAAA | ASO-0844 | OxyGs OxyMCs OxyTs OxyAs DNAts DNAas OxyGs OxyAs OxyAs OxyA |
| | | | TGGTTTATGCA | ASO- | OxyTs OxyGs DNAgs DNAts DNAas DNAts DNAgs DNAcs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 707 | 177608 | 177625 | GGAAGAAGA | ASO-0845 | DNAgs DNAgs DNAas DNAas DNAas DNAgs DNAas DNAas OxyGs OxyA |
| 708 | 177919 | 177935 | AAAGGGATAAT TAAGTGA | ASO-0846 | OxyAs OxyAs OxyAs OxyGs DNAgs DNAas DNAas DNAas DNAas DNAts DNAas DNAts DNAas DNAAs DNAas OxyGs OxyTs OxyGs OxyA |
| 709 | 178222 | 178238 | TTAATCATTGG CTGGGG | ASO-0847 | OxyTs DNAts DNAas DNAas DNAts DNAas DNAcs DNAas DNAts DNAas DNAgs DNAgs DNAcs DNAts DNAgs OxyGs OxyGs OxyG |
| 710 | 178648 | 178665 | GTTTAACTTATA TACAG | ASO-0848 | OxyGs OxyTs OxyTs OxyTs DNAas DNAas DNAas DNAas DNAas DNAts DNAas DNAts DNAas DNAts OxyAs OxyMCs OxyAs OxyG |
| 711 | 178649 | 178667 | GAATTTGAATA AAAGCCT | ASO-0849 | OxyGs OxyAs OxyAs OxyTs DNAts DNAts DNAas DNAgs DNAas DNAts DNAas DNAas DNAas DNAas OxyGs OxyMCs OxyMCs OxyT |
| 712 | 178802 | 178820 | AAGAATTTGAA TAAAAGCC | 0049 | OxyAs OxyAs OxyGs OxyAs DNAas DNAts DNAas DNAts DNAas DNAgs DNAas DNAas DNAts DNAts DNAas OxyAs OxyGs OxyMCs OxyMC |
| 713 | 178822 | 178839 | ATGCTAAATTTT ATCTTGA | ASO-0850 | OxyAs OxyTs OxyGs OxyMCs DNAts DNAas DNAas DNAts DNAas DNAts DNAas DNAts DNAas OxyTs OxyGs OxyA |
| 714 | 178822 | 178840 | CTAATTTTAAAT TGCTGC | ASO-0050 | OxyMCs OxyTs OxyAs DNAas DNAgs DNAas DNAas DNAas DNAts DNAas DNAts DNAas DNAts DNAas DNAas OxyTs OxyGs OxyMC |
| 715 | 178822 | 178841 | TCTAATTTTAAA TTGCTGC | ASO-0051 | OxyTs OxyMCs DNAts DNAas DNAts DNAas DNAgs DNAas DNAts DNAas DNAts DNAas DNAts DNAas OxyTs OxyGs OxyMC |
| 716 | 178823 | 178841 | TTCTAATTTTAA ATTGCTGC | ASO-0851 | OxyTs OxyTs DNAcs DNAts DNAas DNAgs DNAas DNAas DNAas DNAts DNAas DNAts DNAas DNAts OxyTs OxyGs OxyMC |
| 717 | 178823 | 178841 | TTCTAATTTTAA ATTGCTG | ASO-0052 | OxyTs OxyTs OxyMCs OxyTs DNAas DNAts DNAas DNAgs DNAas DNAts DNAas DNAts DNAas DNAts DNAas OxyTs OxyG |
| 718 | 178824 | 178842 | CTTCTAATTTTA AATTGCTG | ASO-0852 | OxyMCs OxyTs OxyTs OxyTs DNAas DNAas DNAas DNAts DNAas DNAas DNAgs OxyMCs OxyTs OxyG |
| 719 | 178824 | 178842 | CTTCTAATTTTA AATTGCT | ASO-0853 | OxyMCs OxyTs OxyTs OxyTs DNAas DNAas DNAts DNAas DNAts DNAas DNAts DNAas OxyGs OxyMCs OxyT |
| 720 | 178825 | 178843 | GCTTCTAATTTT AAATTGCT | ASO-0854 | OxyGs OxyMCs OxyTs OxyTs DNAas DNAts DNAas DNAts DNAas DNAas DNAts DNAas OxyGs OxyAs OxyG |
| 721 | 178825 | 178843 | GCTTCTAATTTT AAATTGC | ASO-0855 | OxyGs OxyMCs OxyTs OxyTs DNAas DNAts DNAas DNAts DNAas DNAas DNAas OxyTs OxyGs OxyMC |
| 722 | 179111 | 179127 | TTATAAGCTTTA GACAG | ASO-0856 | OxyTs OxyTs OxyAs OxyTs DNAas DNAgs DNAts DNAas DNAts DNAas DNAcs DNAas DNAgs OxyAs OxyG |
| 723 | 179547 | 179565 | TTAACCTGAAT TTATTGAG | ASO-0857 | OxyTs OxyTs OxyAs OxyAs DNAcs DNAcs DNAts DNAas DNAts DNAgs DNAas DNAas DNAts DNAts DNAgs OxyTs OxyGs OxyAs OxyG |
| 724 | 179651 | 179667 | ATGAATAGGAT AGGGGT | ASO-0858 | OxyAs OxyTs DNAgs DNAas DNAas DNAts DNAas DNAgs DNAgs DNAas DNAts OxyGs OxyGs OxyGs OxyT |
| 725 | 180041 | 180058 | AGTCAGATAAT TCAATTA | ASO-0859 | OxyAs OxyGs OxyTs OxyMCs DNAas DNAgs DNAas DNAts DNAas DNAas DNAts DNAas OxyAs OxyTs OxyTs OxyA |
| | 180075 | 180092 | AGCTATATTAA | ASO- | OxyAs OxyAs OxyGs OxyMCs OxyTs DNAas DNAts DNAts DNAas DNAas OxyAs DNAts DNAas DNAts DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 726 | 180769 | 180785 | GTAAAAG | ASO-0860 | DNAas DNAgs DNAts DNAats OxyAs DNAas OxyAs OxyAs OxyG |
| 727 | 180774 | 180793 | TTAATATAAGG AGGTAG | ASO-0861 | OxyTs OxyTs OxyAs OxyAs DNAts OxyAs DNAts DNAas DNAts DNAgs DNAaas DNAgs OxyGs OxyTs OxyAs OxyG |
| 728 | 180774 | 180793 | TAATTTATTAA TATAAGGA | ASO-0862 | OxyTs OxyAs OxyAs DNAts DNAts DNAts DNAts DNAas OxyAs OxyGs OxyGs OxyA |
| 729 | 181169 | 181188 | AGATTATCAGG ATTAAATGA | ASO-0863 | OxyAs OxyGs OxyAs OxyTs DNAts DNAas DNAas DNAcs DNAas DNAgs DNAas OxyTs OxyGs OxyA |
| 730 | 181170 | 181188 | AGATTATCAGG ATTAAATG | ASO-0864 | OxyAs OxyGs OxyAs OxyTs DNAts DNAas DNAas OxyAs OxyAs OxyTs OxyG |
| 731 | 181774 | 181791 | CCATGACCTTA TTAATGA | ASO-0865 | OxyMCs OxyMCs OxyAs DNAts DNAgs DNAas DNAcs DNAcs DNAts DNAts DNAts DNAas DNAts DNAas OxyAs OxyTs OxyGs OxyA |
| 732 | 181775 | 181791 | CCATGACCTTA TTAATG | ASO-0866 | OxyMCs OxyMCs OxyAs OxyTs DNAgs DNAas DNAcs DNAcs DNAts DNAts DNAas DNAts DNAas OxyTs OxyG |
| 733 | 182679 | 182696 | AAATTGTTGCT TCTCATC | ASO-0867 | OxyAs OxyAs OxyAs DNAts DNAts DNAgs DNAts DNAts DNAgs DNAcs DNAts OxyTs OxyMC |
| 734 | 182764 | 182780 | TTTTGGAGACT AAGCTA | ASO-0868 | OxyTs OxyTs OxyTs DNAts DNAgs DNAas DNAgs DNAas DNAcs DNAts OxyTs OxyA |
| 735 | 183386 | 183405 | TTCATATCAGT CAAAATGA | ASO-0053 | OxyTs OxyTs OxyMCs OxyAs DNAts DNAas DNAas OxyAs OxyTs OxyGs OxyA |
| 736 | 183560 | 183576 | ATTGTCAGGAT TGGGTC | ASO-0869 | OxyAs OxyTs DNAts DNAgs DNAas DNAgs DNAgs OxyTs OxyMC |
| 737 | 183578 | 183595 | TATTTGGTTATT TGTGAG | ASO-0870 | OxyTs OxyAs OxyTs DNAts DNAgs DNAgs DNAts DNAas DNAts OxyGs OxyAs OxyG |
| 738 | 184119 | 184136 | ATTTGCATAAAT GTTGTG | ASO-0871 | OxyAs OxyTs OxyTs DNAgs DNAcs DNAas DNAas DNAts DNAgs OxyGs OxyTs OxyG |
| 739 | 184370 | 184387 | CCTTGTATTTT GTCTGTT | ASO-0872 | OxyMCs OxyMCs DNAts DNAas DNAgs DNAts DNAas DNAts DNAts OxyTs OxyT |
| 740 | 184697 | 184714 | TTAAAGTTTAT CAGCTT | ASO-0873 | OxyTs OxyTs OxyAs DNAas DNAas DNAgs DNAts DNAts DNAts DNAts DNAts OxyT |
| 741 | 184958 | 184975 | TTGTTTAGTATT CATTTC | ASO-0874 | OxyTs OxyTs OxyTs DNAts DNAgs DNAts DNAas DNAts DNAts DNAas OxyTs OxyMC |
| 742 | 185161 | 185177 | GAGGCTAGAAT AATTTG | ASO-0875 | OxyGs OxyAs OxyGs OxyTs DNAas DNAgs DNAts DNAas DNAts OxyTs OxyG |
| 743 | 185516 | 185533 | ACAATGAAGAA TAGTATA | ASO-0876 | OxyAs OxyMCs OxyAs OxyTs DNAas DNAas DNAts DNAas DNAts OxyAs OxyTs OxyA |
| 744 | 186088 | 186104 | TGTGGAATAAA GTGCAT | ASO-0877 | OxyTs OxyGs OxyGs DNAts DNAas DNAts DNAas DNAas OxyGs OxyMCs OxyAs OxyT |
| 745 | 186089 | 186105 | TTGTGGAATAA | ASO- | OxyTs OxyTs OxyTs OxyGs DNAgs DNAas DNAts DNAaas DNAts DNAas DNAgs DNAts DNAaas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 745 | 186480 | 186499 | TACTTTAAATTTCTCTGAAT | ASO-0878 | DNAas DNAgs DNAts OxyGs OxyMCs OxyA |
| 746 | 186769 | 186787 | TATTCTACTCATTTGCTGT | ASO-0879 | OxyTs OxyAs OxyMCs OxyTs DNAts DNAat DNAas DNAts DNAas DNAts DNAts DNAcs DNAts OxyGs OxyAs OxyT |
| 747 | 186804 | 186820 | TGTAGGCTGTTAACTA | ASO-0880 | OxyTs OxyAs DNAts DNAts DNAgs DNAas DNAts DNAcs DNAts OxyGs OxyT |
| 748 | 187540 | 187559 | ATTTGATTCCATAAATAGCA | ASO-0881 | OxyTs OxyGs OxyTs OxyAs DNAgs DNAcs DNAgs DNAts DNAts OxyTs OxyA |
| 749 | 187541 | 187559 | ATTTGATTCCATAAATAGC | ASO-0882 | ATTTGATTCCAT DNAas OxyTs DNAts DNAts DNAgs DNAas DNAts OxyAs OxyGs OxyMCs OxyA |
| 750 | 187620 | 187638 | TACAAATATATTCTTCACA | ASO-0054 | OxyAs OxyTs OxyTs DNAts DNAgs DNAas DNAas DNAts DNAcs DNAts DNAcs DNAas DNAts OxyGs OxyMC |
| 751 | 187629 | 187647 | TCTCCTTTCTACAAATATA | ASO-0883 | OxyTs OxyAs OxyMCs OxyAs DNAts DNAcs DNAts DNAts OxyMCs OxyAs OxyMCs OxyA |
| 752 | 188596 | 188612 | GTTGTTTGAGGTAATCT | ASO-0884 | OxyTs OxyMCs DNAts DNAcs DNAas DNAts DNAas DNAts OxyAs OxyTs OxyA |
| 753 | 188820 | 188839 | AGGACTGGACTTAATACATT | ASO-0885 | OxyGs OxyTs OxyTs DNAgs DNAts DNAts DNAgs DNAas DNAgs DNAgs |
| 754 | 188823 | 188839 | AGGACTGGACTTAATAC | ASO-0886 | OxyAs DNAgs DNAgs DNAas DNAts DNAas DNAts DNAas OxyMCs OxyAs OxyTs OxyT |
| 755 | 189485 | 189502 | ACACTGGAATGAAATTTT | ASO-0887 | OxyAs OxyGs OxyGs OxyAs DNAas DNAts DNAts OxyAs OxyAs OxyMC |
| 756 | 189696 | 189715 | ATAAGAATTGTGTTGATAAA | ASO-0888 | OxyAs OxyMCs OxyAs DNAas DNAas DNAas OxyTs OxyTs OxyT |
| 757 | 189905 | 189921 | CCTAATTCCTGAAAGAT | ASO-0889 | OxyAs OxyTs OxyAs DNAgs DNAas DNAts DNAts OxyAs OxyAs OxyA |
| 758 | 190098 | 190115 | CTAGTTATCTATCTGTAT | ASO-0890 | OxyMCs OxyMCs DNAts DNAas DNAgs DNAas DNAts DNAcs DNAts OxyAs OxyGs OxyAs OxyT |
| 759 | 190985 | 191003 | ATAAGAAACAAACAACTCA | ASO-0891 | OxyMCs OxyTs OxyTs OxyAs DNAgs DNAas DNAts DNAas DNAas DNAts DNAgs DNAas DNAts OxyAs OxyT |
| 760 | 191733 | 191752 | TGTTGTTTAATTAAGTTCAT | ASO-0892 | OxyAs OxyTs OxyAs OxyGs DNAts DNAas DNAts DNAts DNAas OxyMCs OxyTs OxyAs OxyA |
| 761 | 191737 | 191754 | AATGTTGTTTAATTAAGT | ASO-0893 | OxyTs OxyGs OxyTs OxyGs DNAts DNAts OxyMCs DNAts DNAgs DNAts OxyGs OxyT |
| 762 | 191854 | 191873 | TAAATTTGAGCAAAGAGATG | ASO-0894 | OxyAs OxyAs OxyTs OxyGs DNAts DNAts DNAas OxyAs OxyGs OxyT |
| 763 | 191863 | 191880 | AAAGGAATAAA | ASO-0055 | OxyTs OxyAs OxyAs OxyAs DNAts DNAas DNAgs DNAas OxyAs OxyTs OxyG |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 764 | 192452 | 192471 | TTTGAGC GTTTTGTTCTAA TAATTCTG | ASO-0895 ASO-0896 | DNAts DNAts OxyGs OxyAs OxyGs OxyA OxyMC OxyGs OxyTs OxyAs DNAts DNAgs DNAts DNAts DNAcs DNAts DNAas DNAas DNAts DNAas DNAts DNAaas DNAts OxyMCs OxyTs OxyG |
| 765 | 192638 | 192656 | CTTGTGCTTTT GTGTCATA | ASO-0897 | OxyMCs DNAts DNAts DNAgs DNAts DNAgs DNAts DNAcs OxyAs OxyTs OxyA DNAgs DNAts DNAas DNAts DNAts DNAts DNAts |
| 766 | 192963 | 192980 | GTTGTTAAGTT ACAGAAG | ASO-0898 | OxyGs OxyTs OxyTs OxyGs DNAts DNAts DNAas DNAgs DNAts DNAts DNAas DNAcs DNAaas OxyGs OxyAs OxyG |
| 767 | 193072 | 193091 | AATGATGAGTA ATGTTGAGT | ASO-0899 | DNAas OxyAs OxyTs OxyGs DNAaas DNAts DNAgs DNAts DNAts DNAgs DNAts DNAgs OxyAs OxyGs OxyT |
| 768 | 193590 | 193607 | ATTCAATATTTG TGCTTT | ASO-0900 | OxyAs OxyTs OxyTs OxyMCs DNAaas DNAts DNAts DNAas DNAts DNAts DNAts DNAts DNAgs OxyMCs OxyTs OxyT |
| 769 | 193594 | 193610 | ACCATTCAATA TTTGTG | ASO-0901 | OxyAs DNAas OxyMCs OxyMCs OxyAs DNAts DNAts DNAcs DNAaas DNAts OxyGs OxyTs OxyG |
| 770 | 194118 | 194136 | TGTAAAATTAAA GAGCTAA | ASO-0902 | OxyTs OxyTs OxyGs OxyTs OxyAs DNAaas DNAaas DNAts DNAts DNAaas DNAts OxyMCs OxyTs OxyAs OxyA |
| 771 | 194302 | 194320 | GCAAATATGGA TGAAATTT | ASO-0903 | OxyGs OxyMCs OxyAs DNAaas OxyAs DNAaas DNAts DNAaas OxyAs OxyTs OxyTs OxyT |
| 772 | 195006 | 195024 | CATTTACTCATT ATCCATC | ASO-0904 | OxyMCs OxyAs DNAts DNAts DNAts DNAcs OxyMCs OxyAs OxyTs OxyMC DNAts DNAts DNAas DNAts DNAts |
| 773 | 195355 | 195373 | ATATCTAAATTC CTCTTTC | ASO-0905 | OxyAs OxyTs OxyAs DNAts DNAcs DNAts DNAas OxyTs OxyTs OxyT OxyMC DNAcs DNAts DNAas DNAts DNAts |
| 774 | 195619 | 195636 | GTAGAGTTCAG TCATTT | ASO-0906 | OxyGs DNAts DNAas DNAgs DNAts DNAts OxyTs OxyTs OxyT DNAts DNAcs DNAas OxyTs OxyGs DNAas DNAgs |
| 775 | 195865 | 195883 | TTCTTTTCAATA TTATCTT | ASO-0907 | OxyTs OxyTs OxyMCs OxyTs DNAts DNAts DNAas OxyTs OxyTs OxyT DNAaas DNAts DNAas DNAts DNAts DNAcs DNAas |
| 776 | 196021 | 196037 | GTAGAGGCTAT TAATGA | ASO-0908 | OxyGs OxyTs OxyAs DNAgs DNAaas DNAgs OxyTs OxyGs OxyA DNAaas DNAts DNAas DNAts DNAts |
| 777 | 196644 | 196662 | TACAACAAATT AAAGAGGG | ASO-0909 | OxyTs OxyAs OxyMCs OxyAs DNAaas DNAaas DNAaas OxyAs OxyGs OxyG DNAaas DNAts DNAaas DNAts DNAts |
| 778 | 196726 | 196743 | TTTGTGAAAGA GAACAGG | ASO-0910 | OxyTs OxyTs OxyGs OxyTs DNAgs DNAaas OxyMCs OxyAs OxyGs OxyG DNAgs DNAaas DNAts DNAts DNAts |
| 779 | 197052 | 197069 | AGATGAGGAAT ATGATGG | ASO-0911 | OxyAs OxyGs OxyAs OxyTs DNAgs DNAaas OxyTs OxyGs OxyG DNAaas DNAts DNAts DNAts |
| 780 | 197054 | 197073 | TATTAGATGAG GAATATGAT | ASO-0056 | OxyTs OxyAs OxyTs OxyTs DNAts DNAts DNAgs DNAts OxyAs OxyGs OxyAs OxyT DNAgs DNAaas DNAts DNAts |
| 781 | 197415 | 197434 | TTGTTTGATTTA AATTTCAC | ASO-0912 | OxyTs OxyTs OxyGs OxyTs DNAts DNAts DNAts OxyTs OxyMCs OxyAs OxyMC DNAaas DNAts DNAts DNAts |
| 782 | 197528 | 197546 | CAATCTTGATTT | ASO- | OxyMCs OxyAs OxyAs OxyTs DNAcs DNAts DNAaas DNAts DNAgs DNAaas OxyAs OxyMC |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 783 | 197899 | 197915 | AATTTTC TGATGGAGATA ACTAGT | ASO-0913 | DNAts DNAas DNAats DNAts OxyTs OxyTs OxyMC |
| 784 | 198307 | 198324 | TAGTTTGGTGG ATGGTGC | ASO-0914 | OxyTs OxyGs OxyAs DNAts DNAgs DNAas DNAgs DNAas DNAgs DNAas DNAts OxyTs OxyAs OxyGs OxyT |
| 785 | 198518 | 198537 | AATGTGTGGGT TTTCTTTCA | ASO-0915 | OxyTs DNAas DNAts DNAgs DNAgs DNAts DNAts OxyGs OxyMC |
| 786 | 199058 | 199077 | TATTTAATTTAA TGAATGCC | ASO-0916 | OxyAs OxyAs DNAts DNAgs DNAts DNAcs DNAts DNAts OxyTs OxyMCs OxyA |
| 787 | 199070 | 199088 | ATATATGGCTT TATTTAAT | ASO-0917 | OxyTs OxyAs OxyTs DNAts DNAas DNAts DNAas OxyTs OxyGs OxyMCs OxyMC |
| 788 | 199524 | 199540 | ATTGAGGTAAG TCTAGA | ASO-0918 | OxyAs OxyTs OxyAs OxyTs DNAas DNAts DNAgs DNAcs DNAts DNAts OxyT |
| 789 | 199581 | 199599 | TTATCTAAAATC TTATTTA | ASO-0919 | OxyAs OxyTs OxyTs DNAgs DNAas DNAts DNAts OxyAs OxyGs OxyA |
| 790 | 199958 | 199975 | AATGGTTTATT GTATGTG | ASO-0920 | OxyTs OxyAs OxyTs OxyAs DNAcs DNAts DNAts DNAas OxyTs OxyTs OxyA |
| 791 | 200729 | 200745 | CTACAGGGACT TACAAG | ASO-0921 | OxyAs OxyAs OxyTs OxyGs DNAgs DNAts DNAts DNAts DNAts OxyGs OxyG |
| 792 | 200739 | 200756 | ATATTTATTAC TACAGG | ASO-0922 | OxyMCs OxyTs OxyAs OxyAs OxyMCs DNAas DNAcs OxyAs OxyAs OxyG |
| 793 | 200989 | 201007 | GAGAGGAGAG AATAATGAA | ASO-0923 | OxyAs OxyTs OxyAs OxyTs DNAts DNAas DNAas OxyMCs OxyAs OxyG |
| 794 | 201838 | 201855 | TACTGTTACTG TTGATCC | ASO-0924 | OxyGs OxyAs OxyAs OxyGs DNAgs DNAas DNAas OxyTs OxyGs OxyAs OxyA |
| 795 | 201843 | 201862 | GAGGAGATACT GTTACTGTT | ASO-0925 | OxyTs DNAas DNAgs DNAas DNAts OxyTs OxyMCs OxyMC |
| 796 | 202054 | 202073 | TTCTAACATATT TCTAATCA | ASO-0057 | OxyGs OxyAs DNAgs DNAas DNAcs DNAts DNAts DNAgs OxyTs OxyT |
| 797 | 202186 | 202204 | TAATTCATCTAA AAGTTAG | ASO-0926 | OxyTs OxyTs OxyAs OxyMCs DNAts DNAas DNAts DNAas OxyTs OxyMCs DNAts DNAas |
| 798 | 202670 | 202687 | TATTAACTATTG GAATTC | ASO-0927 | OxyTs OxyAs OxyAs OxyTs DNAts DNAgs OxyTs OxyAs OxyG |
| 799 | 202673 | 202690 | ATGTATTAACTA TTGGAA | ASO-0928 | OxyTs OxyAs OxyGs OxyTs DNAts DNAas DNAgs OxyTs OxyTs OxyMC |
| 800 | 203349 | 203368 | ATATCAGGGAC TTCAGTATC | ASO-0929 | OxyAs OxyTs OxyAs DNAts DNAcs DNAas DNAgs DNAcs OxyGs OxyAs OxyA |
| 801 | 203606 | 203623 | TTTTAATTCTTG | ASO-0930 | OxyTs OxyTs OxyTs OxyTs DNAas DNAts DNAcs DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 802 | 203712 | 203728 | AAGTCA CAGTTTTCATA ATCACC | ASO-0931 | DNAgs DNAas OxyGs DNAas OxyTs OxyMCs OxyA OxyMCs OxyAs OxyGs OxyTs DNAts DNAts DNAcs DNAas DNAts DNAas |
| 803 | 204117 | 204133 | CGTATATTATG AGCATG | ASO-0932 | DNAas DNAts DNAcs OxyAs OxyMCs OxyMC OxyMCs OxyGs OxyTs OxyAs DNAas DNAts DNAas DNAts DNAas DNAts DNAas |
| 804 | 204562 | 204579 | ATTTGTATCCC ACCTATC | ASO-0933 | DNAas DNAgs OxyMCs OxyAs OxyTs OxyG OxyAs DNAts DNAts DNAas DNAgs DNAas DNAts DNAas DNAcs DNAas DNAcs |
| 805 | 204568 | 204584 | GCTTAATTTGT ATCCCA | ASO-0934 | DNAas DNAcs DNAcs DNAts OxyAs OxyTs OxyMC DNAas OxyMCs DNAts DNAts DNAas DNAts DNAas DNAts DNAgs DNAts |
| 806 | 204987 | 205005 | GTGAATAAGTG ATTAAATA | ASO-0935 | DNAas DNAts DNAcs DNAcs OxyMCs OxyA OxyGs OxyTs OxyAs DNAas DNAts DNAas DNAgs DNAts DNAgs |
| 807 | 205172 | 205188 | TATGGGGATAC AATGAA | ASO-0936 | DNAas DNAts DNAts DNAas OxyAs OxyAs OxyTs OxyA OxyTs OxyAs OxyTs OxyGs DNAgs DNAas DNAts DNAas DNAcs |
| 808 | 205690 | 205706 | AGTAATGGAGA TTAAGG | ASO-0937 | DNAas DNAas OxyTs OxyGs OxyAs OxyA OxyAs OxyGs OxyAs OxyAs DNAts DNAas DNAgs DNAas DNAts DNAas |
| 809 | 205860 | 205879 | GAGAAATGTCT GTTGTTCAA | ASO-0938 | DNAts DNAts OxyAs OxyAs OxyGs OxyG OxyGs OxyAs DNAgs DNAas DNAts DNAas DNAgs DNAts DNAcs DNAts |
| 810 | 206273 | 206291 | AGGCAGAAGTT GTAATGGT | ASO-0939 | DNAgs DNAts DNAgs DNAts DNAts OxyMCs OxyAs OxyA OxyAs OxyGs DNAgs DNAcs DNAas DNAgs DNAts DNAas DNAts |
| 811 | 206274 | 206292 | AAGGCAGAAGT TGTAATGG | ASO-0058 | DNAgs DNAas DNAas DNAts DNAgs OxyGs OxyT OxyAs OxyGs OxyGs DNAcs DNAas DNAgs DNAts DNAas DNAts DNAas |
| 812 | 206749 | 206766 | ATTTCATCAGT AATAGAT | ASO-0940 | DNAas DNAts DNAts DNAts OxyAs OxyGs OxyAs OxyT OxyAs OxyTs OxyTs OxyAs DNAas DNAts DNAts DNAas DNAts |
| 813 | 207074 | 207091 | TTAGAGATTTT GTGAATA | ASO-0941 | DNAgs DNAts DNAgs OxyAs OxyTs OxyA OxyTs OxyTs OxyTs DNAts DNAas DNAas OxyMCs OxyAs OxyTs OxyA |
| 814 | 207236 | 207254 | ATTTTCTAACTT TAACATA | ASO-0942 | DNAts DNAts DNAas DNAas OxyMCs OxyAs OxyTs OxyA OxyTs OxyAs DNAts DNAts DNAas DNAcs DNAts DNAts |
| 815 | 207748 | 207767 | TACTGATCTTT GTTATGTTA | ASO-0943 | DNAas DNAts DNAas DNAts DNAas DNAts DNAts DNAts OxyMCs OxyTs OxyGs OxyAs OxyAs DNAts DNAas DNAcs DNAs DNAts |
| 816 | 207753 | 207769 | CTTACTGATCT TGTTA | ASO-0944 | DNAts DNAts DNAas DNAts DNAas DNAts DNAas OxyTs OxyTs DNAts DNAas DNAas DNAcs DNAts DNAas DNAts |
| 817 | 208449 | 208468 | TTTTGCTTTATT AAGTTCTG | ASO-0945 | OxyTs OxyTs DNAts DNAas DNAas DNAts DNAts OxyMCs OxyMCs OxyTs OxyG DNAts DNAas DNAas DNAas DNAas DNAts |
| 818 | 208505 | 208522 | GAGTGAGATAA AAGGATG | ASO-0946 | OxyGs OxyAs OxyGs OxyTs DNAas DNAts DNAcs DNAas DNAts DNAts OxyG |
| 819 | 208949 | 208966 | GAATTTCTTGG TTATTAG | ASO-0947 | OxyGs OxyAs OxyAs OxyTs OxyTs DNAts DNAts DNAts DNAas DNAts DNAcs DNAts DNAts OxyAs OxyG DNAts DNAas |
| 820 | 209096 | 209112 | AATTTTGTAGA | ASO-0948 | OxyAs OxyAs OxyTs OxyTs DNAts DNAgs DNAts DNAas DNAgs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 821 | 209851 | 209869 | GCAGAC | 0949 | DNAgs DNAcs OxyAs OxyGs OxyAs OxyMC |
| 822 | 209852 | 209869 | TTGCCACTATG TCTTCAAA | ASO-0950 | OxyTs DNAts DNAgs DNAcs DNAas DNAts DNAas DNAgs DNAts DNAcs DNAts OxyMCs OxyAs OxyA |
| 823 | 209852 | 209868 | TGCCACTATGT CTTCAA | ASO-0951 | OxyTs OxyGs DNAcs DNAcs DNAts DNAas DNAts DNAgs DNAts DNAts DNAts OxyMCs OxyAs OxyA |
| 824 | 209852 | 209869 | TTGCCACTATG TCTTCAA | ASO-0952 | OxyTs DNAts DNAgs DNAcs DNAcs DNAas DNAts DNAas DNAts DNAcs DNAts OxyMCs OxyAs OxyA |
| 825 | 209853 | 209869 | TTGCCACTATG TCTTCA | ASO-0953 | OxyTs DNAts DNAgs DNAcs DNAas DNAts DNAas DNAts DNAcs DNAts OxyTs OxyMCs OxyA |
| 826 | 209888 | 209904 | CACTTACCTGG CATCAG | ASO-0954 | OxyMCs OxyAs DNAcs DNAts DNAts DNAas DNAcs DNAts DNAgs DNAgs DNAcs DNAts DNAts OxyAs OxyG |
| 827 | 210073 | 210092 | TTGATAAAATAT GTAATCTA | ASO-0955 | OxyTs OxyTs OxyGs DNAts DNAas DNAas DNAas OxyTs OxyMCs OxyTs OxyA |
| 828 | 210416 | 210435 | TTAGATATTCAT TGTTCAGT | ASO-0956 | OxyTs OxyTs OxyAs DNAgs DNAts DNAts DNAts DNAcs OxyAs OxyGs OxyT |
| 829 | 210513 | 210530 | AAGGGTTTTAA TGAAATT | ASO-0957 | OxyAs OxyAs OxyGs OxyGs DNAas OxyAs OxyAs OxyTs OxyT |
| 830 | 210750 | 210769 | ACAGAATATAT AAAAGTACA | ASO-0059 | OxyAs OxyMCs OxyAs OxyGs DNAas DNAas DNAgs OxyTs OxyAs OxyMCs OxyA |
| 831 | 210752 | 210770 | TACAGAATATA TAAAGTA | ASO-0958 | OxyTs OxyAs OxyMCs OxyAs DNAcs DNAas DNAas OxyAs OxyAs OxyTs OxyA |
| 832 | 211144 | 211160 | TTTGGGGTAAA CTGAGC | ASO-0959 | OxyTs OxyTs DNAts DNAts DNAgs DNAgs DNAgs DNAgs OxyGs OxyMC |
| 833 | 211327 | 211344 | TTTTAATTTCAA CCAGTA | ASO-0960 | OxyTs OxyTs OxyTs DNAts DNAas DNAts DNAts OxyGs OxyTs OxyA |
| 834 | 211798 | 211814 | CTAGTGAGAAT GGATTC | ASO-0961 | OxyMCs OxyTs OxyAs OxyGs DNAts DNAgs DNAas DNAgs OxyTs OxyTs OxyMC |
| 835 | 211970 | 211986 | TAAACCATAGG AATCTT | ASO-0962 | OxyTs OxyAs OxyAs OxyAs DNAcs DNAcs DNAas DNAts DNAgs DNAts OxyT |
| 836 | 212270 | 212287 | TTGTATAAGTT CACTGTG | ASO-0963 | OxyTs OxyTs OxyGs OxyTs DNAas DNAts DNAas DNAts OxyGs OxyTs OxyG |
| 837 | 212647 | 212666 | AGTATATAACA GGAAAACAA | ASO-0964 | OxyAs OxyGs OxyTs OxyAs DNAgs DNAcs DNAas DNAas OxyAs OxyMCs OxyAs OxyA |
| 838 | 213141 | 213158 | AAAGGCACATA ATCACAT | ASO-0965 | OxyAs OxyAs OxyAs OxyGs OxyAs DNAgs DNAcs OxyAs OxyCs OxyAs OxyT |
| 839 | 213141 | 213159 | TAAAGGCACAT AATCACAT | ASO-0966 | OxyTs OxyAs OxyAs OxyAs DNAgs DNAgs DNAcs OxyAs OxyMCs OxyAs OxyT |
| | 213143 | 213159 | TAAAGGCACAT | ASO- | OxyTs OxyAs OxyAs OxyAs DNAgs DNAgs DNAcs OxyAs DNAcs DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 840 | 213144 | 213163 | AATCAC | ASO-0967 | DNAas DNAas OxyTs OxyMCs OxyAs OxyMC |
| 841 | 213145 | 213163 | ATTTTAAAGGC ACATAATCA | ASO-0968 | OxyAs OxyTs OxyTs OxyTs DNAts DNAas DNAgs DNAgs DNAcs DNAas DNAas DNAcs DNAas OxyAs OxyTs OxyMCs OxyA |
| 842 | 213145 | 213164 | CATTTTAAAGG CACATAATC | ASO-0969 | OxyMCs OxyAs OxyTs OxyTs DNAts DNAas DNAts OxyAs OxyAs OxyTs OxyMC |
| 843 | 213146 | 213165 | ACATTTTAAAG GCACATAAT | ASO-0060 | OxyMCs OxyAs OxyTs OxyTs DNAts DNAas DNAts DNAas OxyTs OxyAs OxyAs OxyT |
| 844 | 213146 | 213164 | CATTTTAAAGG CACATAAT | ASO-0970 | DNAgs DNAcs DNAas DNAcs DNAas DNAcs DNAas OxyTs OxyAs OxyAs OxyT |
| 845 | 213147 | 213165 | ACATTTTAAAG GCACATAAA | ASO-0971 | OxyAs OxyMCs OxyAs OxyTs DNAts DNAas DNAas OxyTs OxyAs OxyA |
| 846 | 213147 | 213166 | AACATTTTAAA GGCACATAA | ASO-0972 | OxyAs OxyMCs OxyAs OxyTs DNAts DNAas DNAts DNAas DNAas DNAas OxyA |
| 847 | 213148 | 213166 | AACATTTTAAA GGCACATA | ASO-0061 | OxyAs OxyMCs OxyAs OxyTs DNAts DNAas OxyMCs OxyAs OxyTs OxyA |
| 848 | 213148 | 213167 | GAACATTTTAA AGGCACATA | ASO-0062 | OxyGs OxyAs OxyAs DNAcs DNAts DNAts DNAts DNAts DNAas OxyTs OxyA |
| 849 | 213149 | 213167 | GAACATTTTAA AGGCACAT | ASO-0063 | OxyGs OxyAs OxyAs OxyMCs DNAts DNAas DNAcs OxyAs OxyAs OxyT |
| 850 | 213149 | 213168 | AGAACATTTTA AAGGCACAT | ASO-0064 | OxyAs OxyGs OxyAs OxyAs DNAcs DNAas DNAcs OxyMCs OxyAs OxyT |
| 851 | 213150 | 213168 | AGAACATTTTA AAGGCACA | ASO-0065 | OxyAs OxyGs OxyAs DNAas DNAas OxyMCs OxyMCs OxyA |
| 852 | 213150 | 213169 | GAGAACATTTT AAAGGCACA | ASO-0066 | OxyGs OxyAs OxyGs DNAas DNAas DNAgs OxyMCs OxyA |
| 853 | 213151 | 213169 | GAGAACATTTT AAAGGCAC | ASO-0067 | OxyGs OxyAs OxyGs OxyAs DNAas DNAas DNAcs DNAts DNAts OxyMC |
| 854 | 213153 | 213172 | AGGGAGAACAT TTTAAAGGC | ASO-0068 | OxyAs DNAgs DNAgs DNAgs DNAas DNAcs DNAas OxyGs OxyGs OxyMC |
| 855 | 213154 | 213172 | AGGGAGAACAT TTTAAAGG | ASO-0069 | OxyAs OxyGs OxyGs DNAts DNAts DNAas DNAas OxyGs OxyGs OxyG |
| 856 | 213155 | 213172 | AGGGAGAACAT TTTAAAG | ASO-0070 | OxyAs OxyGs OxyGs DNAts DNAts DNAas OxyAs OxyAs OxyG |
| 857 | 213160 | 213177 | ATGGAAGGGA GAACATTT | ASO-0973 | OxyAs OxyTs OxyGs OxyGs DNAas DNAgs DNAgs DNAas OxyTs OxyT |
| 858 | 213177 | 213195 | CAAAGATACAA GGGCAGAA | ASO-0974 | OxyMCs OxyAs OxyAs OxyGs OxyAs DNAgs DNAcs DNAas OxyAs OxyA |
| | 213178 | 213195 | CAAAGATACAA | ASO- | OxyMCs OxyAs OxyAs DNAgs DNAas DNAcs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 859 | 213182 | 213199 | GGGCAGAACTGCAAAGAT | ASO-0975 | DNAas DNAgs DNAgs DNAts DNAgs OxyMCs OxyAs OxyGs OxyA |
| 860 | 213182 | 213199 | ACTGCAAAGATACAAGGG | ASO-0976 | OxyAs OxyMCs DNAts DNAgs DNAcs DNAas DNAas DNAgs DNAts DNAas DNAcs DNAas OxyAs OxyGs OxyG |
| 861 | 213183 | 213200 | GACTGCAAAGATACAAGGG | ASO-0977 | OxyGs DNAas DNAts DNAgs DNAcs DNAas DNAas DNAgs OxyGs OxyG |
| 862 | 213183 | 213200 | GACTGCAAAGATACAAGG | ASO-0978 | DNAas DNAts DNAas DNAcs DNAas OxyAs OxyAs OxyGs OxyG |
| 863 | 213183 | 213201 | TGACTGCAAAGATACAAGG | ASO-0979 | OxyTs OxyGs OxyAs DNAcs DNAts DNAgs DNAcs DNAas DNAas DNAgs OxyGs OxyG |
| 864 | 213183 | 213202 | ATGACTGCAAAGATACAAGG | ASO-0980 | OxyAs OxyTs DNAgs DNAcs DNAts DNAgs DNAcs DNAas OxyAs OxyGs OxyG |
| 865 | 213184 | 213201 | TGACTGCAAAGATACAAG | ASO-0981 | OxyTs OxyGs OxyAs OxyMCs DNAts DNAgs DNAcs OxyAs OxyAs OxyG |
| 866 | 213184 | 213202 | ATGACTGCAAAGATACAAG | ASO-0982 | OxyAs OxyTs OxyGs DNAcs DNAts DNAgs DNAcs OxyAs OxyAs OxyG |
| 867 | 213184 | 213203 | AATGACTGCAAAGATACAAG | ASO-0983 | OxyAs OxyAs OxyTs OxyGs DNAas DNAts DNAgs OxyMCs OxyAs OxyAs OxyG |
| 868 | 213185 | 213204 | CAATGACTGCAAAGATACAA | ASO-0984 | OxyMCs OxyAs OxyAs OxyTs DNAgs DNAas DNAts DNAas OxyMCs OxyAs OxyA |
| 869 | 213186 | 213204 | CAATGACTGCAAAGATACA | ASO-0985 | OxyMCs OxyAs OxyAs OxyAs DNAts DNAgs DNAas OxyTs OxyAs OxyMCs OxyA |
| 870 | 213186 | 213205 | ACAATGACTGCAAAGATACA | ASO-0986 | OxyAs OxyMCs OxyAs OxyAs DNAts DNAgs DNAas OxyAs OxyMCs OxyA |
| 871 | 213187 | 213205 | ACAATGACTGCAAAGATAC | ASO-0987 | OxyAs OxyMCs OxyAs DNAas DNAgs OxyAs DNAts OxyTs OxyAs OxyMC |
| 872 | 213188 | 213206 | TACAATGACTGCAAAGATA | ASO-0988 | OxyTs OxyAs OxyMCs OxyAs DNAas DNAas DNAgs OxyAs OxyTs OxyA |
| 873 | 213189 | 213208 | TATACAATGACTGCAAAGAT | ASO-0989 | OxyTs OxyAs DNAts DNAas DNAcs DNAas DNAas DNAgs DNAas DNAcs |
| 874 | 213191 | 213208 | TATACAATGACTGCAAAG | ASO-0990 | OxyTs OxyAs OxyTs OxyAs DNAcs DNAas DNAas OxyAs OxyAs OxyG |
| 875 | 213240 | 213256 | AACTATGCCATTAGGT | ASO-0991 | OxyAs OxyAs DNAts DNAas OxyAs OxyGs OxyT |
| 876 | 213240 | 213257 | GAACTATGCCATTTAGGT | ASO-0992 | OxyGs OxyAs DNAas DNAts DNAts DNAas DNAcs DNAas DNAts |
| 877 | 213240 | 213259 | GTGAACTATGCCATTTAGGT | ASO-0993 | OxyGs DNAts DNAgs DNAas DNAts DNAts DNAas DNAgs OxyGs OxyT |
| | 213241 | 213257 | GAACTATGCCA | ASO- | OxyGs OxyAs OxyMCs DNAts DNAts DNAas DNAgs DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 878 | 213241 | | TTTAGG | ASO-0994 | DNAas DNAts DNAts DNAat DNAas OxyGs DNAts OxyG |
| 879 | 213241 | 213258 | TGAACTATGCC ATTTAGG | ASO-0995 | OxyTs DNAgs DNAts DNAgs DNAts DNAas DNAts DNAgs DNAcs DNAts DNAts DNAts OxyAs OxyGs OxyG |
| 880 | 213242 | 213259 | GTGAACTATGC CATTTAGG | ASO-0996 | OxyGs DNAts DNAgs DNAas DNAts DNAts OxyAs OxyGs OxyG DNAcs DNAas DNAts DNAgs DNAts DNAas DNAts DNAgs DNAcs |
| 881 | 213242 | 213259 | GTGAACTATGC CATTTAG | ASO-0997 | OxyGs OxyTs DNAgs DNAas DNAts DNAts DNAas DNAts DNAgs DNAcs DNAts OxyT DNAcs DNAas DNAts DNAts OxyTs OxyAs OxyG |
| 882 | 213242 | 213260 | TGTGAACTATG CCATTTAG | ASO-0998 | OxyTs DNAgs DNAts DNAgs DNAas DNAts DNAts DNAas DNAts DNAgs DNAs DNAcs DNAas DNAts DNAts OxyTs OxyAs OxyG |
| 883 | 213242 | 213261 | CTGTGAACTAT GCCATTTAG | ASO-0999 | OxyMCs DNAts DNAgs DNAts DNAgs DNAas DNAts DNAts DNAas DNAts DNAgs DNAcs DNAts DNAts DNAs DNAts OxyAs OxyG |
| 884 | 213243 | 213259 | GTGAACTATGC CATTTA | ASO-1000 | OxyGs OxyTs DNAgs DNAas DNAts DNAts DNAas DNAts DNAgs DNAcs DNAts DNAts OxyTs OxyTs OxyA |
| 885 | 213243 | 213260 | TGTGAACTATG CCATTTA | ASO-1001 | OxyTs OxyGs OxyTs DNAgs DNAas DNAts DNAts DNAas DNAts DNAgs DNAcs DNAts DNAts OxyTs OxyA |
| 886 | 213243 | 213261 | CTGTGAACTAT GCCATTTA | ASO-1002 | OxyMCs DNAts DNAgs DNAts DNAgs DNAas DNAts DNAts DNAas DNAts DNAgs DNAcs DNAs DNAts OxyTs OxyTs OxyA |
| 887 | 213246 | 213262 | CCTGTGAACTA TGCCAT | ASO-1003 | OxyMCs OxyMCs DNAts DNAgs DNAts DNAgs DNAas DNAts DNAts DNAas DNAts DNAgs DNAs DNAcs DNAs OxyAs OxyT |
| 888 | 213248 | 213263 | CCCTGTGAACT ATGCC | ASO-1004 | OxyMCs DNAcs DNAcs DNAts DNAgs DNAts DNAgs DNAas DNAts DNAts DNAas DNAts DNAgs OxyMCs OxyMC |
| 889 | 213267 | 213283 | CCATATACTGA CCTTCA | ASO-1005 | OxyMCs OxyMCs OxyAs DNAts DNAts DNAas DNAts DNAts OxyMCs OxyA DNAas DNAcs DNAcs DNAts DNAts OxyMCs OxyA |
| 890 | 213267 | 213284 | TCCATATACTG ACCTTCA | ASO-1006 | OxyTs OxyMCs DNAcs DNAas DNAts DNAts DNAas DNAts DNAts OxyTs OxyMCs OxyA DNAgs DNAas DNAcs DNAcs DNAts OxyMCs OxyA |
| 891 | 213268 | 213284 | TCCATATACTG ACCTTC | ASO-1007 | OxyTs OxyMCs DNAcs DNAas DNAts DNAts DNAas DNAts DNAts OxyTs OxyMCs OxyMC DNAgs DNAas DNAcs DNAcs OxyMCs OxyMC |
| 892 | 213269 | 213285 | CTCCATATACT GACCTT | ASO-1008 | OxyMCs DNAts DNAcs DNAcs DNAas DNAts DNAts DNAas DNAts DNAts OxyMCs OxyMCs OxyTs OxyT |
| 893 | 213269 | 213286 | ACTCCATATAC TGACCTT | ASO-1009 | OxyAs OxyMCs DNAts DNAcs DNAcs DNAas DNAts DNAts DNAas DNAts DNAts OxyMCs OxyMCs OxyTs OxyT |
| 894 | 213270 | 213286 | ACTCCATATAC TGACCT | ASO-1010 | OxyAs OxyMCs DNAts DNAcs DNAcs DNAas DNAts DNAts DNAas DNAts DNAts OxyMCs OxyMCs OxyT |
| 895 | 213271 | 213287 | GACTCCATATA CTGACC | ASO-1011 | OxyGs OxyAs OxyMCs DNAts DNAcs DNAcs DNAas DNAts DNAts DNAas DNAts DNAts OxyMCs OxyMC |
| 896 | 213450 | 213467 | TTTTGCTATGAT GTATAT | ASO-1012 | OxyTs OxyTs OxyTs OxyTs DNAgs DNAcs DNAts DNAas DNAts DNAgs DNAats DNAts OxyAs OxyT |
| | 213587 | 213605 | AGGCGGACATA | ASO- | OxyAs DNAgs DNAgs DNAmcs DNAgs DNAgs DNAcs DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 897 | 213587 | 213606 | CATCACAG | 1013 | DNAas DNAcs DNAts DNAts DNAcs DNAgs DNAts DNAcs DNAcs OxyAs OxyG |
| 898 | 213588 | 213606 | CAGGCGGACAT ACATCACAG | ASO-1014 | OxyMCs DNAas DNAgs DNAmcs DNAgs DNAas DNAgs DNAcs DNAgs DNAcs DNAas DNAts DNAAas DNAts DNAcs OxyAs OxyG |
| 899 | 213588 | 213605 | AGGCGGACATA CATCACA | ASO-1015 | OxyAs OxyGs DNAgs DNAmcs DNAas DNAts DNAcs DNAas DNAts DNAcs DNAas OxyMCs OxyA |
| 900 | 213589 | 213606 | CAGGCGGACAT ACATCACA | ASO-1016 | OxyMCs DNAas DNAgs DNAmcs DNAgs DNAas DNAgs DNAcs DNAas DNAts DNAcs DNAas OxyMCs OxyA |
| 901 | 213589 | 213605 | AGGCGGACATA CATCAC | ASO-1017 | DNAts DNAas DNAcs DNAas DNAgs DNAmcs DNAgs DNAas DNAgs DNAcs DNAas OxyMCs OxyAs OxyMC |
| 902 | 213589 | 213606 | CAGGCGGACAT ACATCAC | ASO-1018 | OxyMCs DNAas DNAcs DNAas DNAts DNAcs DNAas OxyTs OxyMCs OxyAs OxyMC |
| 903 | 213589 | 213607 | ACAGGCGGAC ATACATCAC | ASO-1019 | OxyAs DNAcs DNAas DNAgs DNAmcs DNAgs DNAas DNAgs DNAcs DNAas DNAts OxyMCs OxyAs OxyMC |
| 904 | 213589 | 213608 | TACAGGCGGAC ATACATCAC | ASO-1020 | OxyTs OxyAs DNAcs DNAas DNAgs DNAmcs DNAgs DNAas DNAgs DNAcs DNAas DNAts DNAcs OxyAs OxyMC |
| 905 | 213590 | 213605 | AGGCGGACATA CATCA | ASO-1021 | OxyAs OxyGs DNAgs DNAmcs DNAgs DNAas DNAgs DNAcs OxyAs OxyTs OxyMCs OxyA |
| 906 | 213590 | 213606 | CAGGCGGACAT ACATCA | ASO-1022 | OxyMCs OxyAs DNAgs DNAmcs DNAgs DNAas DNAcs DNAas OxyTs OxyMCs OxyA |
| 907 | 213590 | 213607 | ACAGGCGGAC ATACATCA | ASO-1023 | OxyAs OxyMCs DNAas DNAgs DNAmcs DNAgs DNAas DNAcs DNAas OxyTs OxyMCs OxyA |
| 908 | 213590 | 213608 | TACAGGCGGAC ATACATCA | ASO-1024 | OxyTs DNAas DNAts DNAas DNAgs DNAcs DNAas DNAgs DNAcs DNAas OxyTs OxyMCs OxyA |
| 909 | 213591 | 213606 | CAGGCGGACAT ACATC | ASO-1025 | OxyMCs OxyAs DNAgs DNAmcs DNAgs DNAas DNAcs DNAas OxyMCs OxyAs OxyTs OxyMC |
| 910 | 213591 | 213607 | ACAGGCGGAC ATACATC | ASO-1026 | DNAas DNAts DNAas DNAcs OxyMCs OxyAs DNAcs DNAas OxyMCs OxyTs OxyMC |
| 911 | 213591 | 213608 | TACAGGCGGAC ATACATC | ASO-1027 | OxyTs DNAas DNAts DNAas DNAcs OxyMCs DNAgs DNAas OxyAs OxyTs OxyMC |
| 912 | 213591 | 213609 | CTACAGGCGGA CATACATC | ASO-1028 | OxyMCs DNAas DNAts DNAcs DNAas DNAcs DNAas DNAts DNAcs DNAas OxyTs OxyMC |
| 913 | 213592 | 213608 | TACAGGCGGAC ATACAT | ASO-1029 | OxyTs OxyAs OxyMCs DNAas DNAcs DNAas DNAcs DNAas OxyMCs OxyAs OxyT |
| 914 | 213592 | 213609 | CTACAGGCGGA CATACAT | ASO-1030 | OxyMCs DNAts DNAcs DNAts DNAas DNAcs DNAas DNAts DNAcs DNAas OxyMCs OxyAs OxyT |
| 915 | 213592 | 213610 | TCTACAGGCGG ACATACAT | ASO-1031 | OxyTs DNAas DNAgs DNAas DNAcs DNAas DNAts DNAas OxyMCs DNAas DNAmcs DNAgs OxyT |
| — | 213593 | 213608 | TACAGGCGGAC | ASO- | OxyTs OxyAs OxyMCs DNAgs DNAas DNAcs DNAas DNAmcs DNAgs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 916 | 213593 | 213609 | CTACAGGCGGA ATACA | ASO-1032 | DNAcs DNAas DNAts DNAas DNAts OxyMCs OxyA |
| 917 | 213593 | 213610 | CTACAGGCGGA CATACA | ASO-1033 | OxyMCs DNAts DNAas DNAcs DNAas DNAgs DNAgs DNAmcs DNAgs DNAas DNAas DNAAas OxyTs OxyAs OxyMCs OxyA |
| 918 | 213594 | 213610 | TCTACAGGCGG ACATACA | ASO-1034 | OxyTs OxyMCs DNAts DNAas DNAcs DNAas DNAgs DNAgs DNAmcs DNAgs DNAas DNAgs DNAas DNAts DNAas OxyMCs OxyA |
| 919 | 213595 | 213610 | TCTACAGGCGG ACATAC | ASO-1035 | OxyTs OxyMCs DNAts DNAas DNAcs DNAas DNAgs DNAgs DNAas DNAgs DNAas OxyAs OxyTs OxyAs OxyMC |
| 920 | 213597 | 213610 | TCTACAGGCGG ACATA | ASO-1036 | OxyTs OxyMCs DNAts DNAas DNAcs DNAas DNAgs DNAgs DNAas DNAgs DNAmcs DNAgs DNAas OxyMCs OxyAs OxyTs OxyA |
| 921 | 213597 | 213612 | AATCTACAGGC GGACA | ASO-1037 | OxyAs OxyAs OxyTs DNAcs DNAas DNAgs DNAgs DNAas DNAcs DNAas DNAgs DNAgs DNAmcs DNAgs OxyGs OxyAs OxyMCs OxyA |
| 922 | 213597 | 213613 | AAATCTACAGG CGGACA | ASO-1038 | OxyAs OxyAs OxyAs DNAts DNAcs DNAas DNAgs DNAgs DNAcs DNAas DNAcs DNAas DNAgs DNAgs OxyAs OxyMCs OxyA |
| 923 | 213598 | 213612 | AATCTACAGGC GGAC | ASO-1039 | OxyAs OxyAs OxyTs OxyMCs DNAts DNAcs DNAas DNAgs DNAgs DNAcs DNAas DNAcs DNAas DNAmcs DNAgs OxyGs OxyAs OxyMC |
| 924 | 213612 | 213629 | ACAGAAGTGGT GTTTAAA | ASO-1040 | OxyAs OxyMCs OxyAs OxyGs DNAas DNAas DNAgs DNAts DNAgs DNAts DNAas DNAts DNAts DNAts OxyTs OxyAs OxyAs OxyA |
| 925 | 213612 | 213630 | AACAGAAGTGG TGTTTAAA | ASO-1041 | OxyAs OxyAs OxyAs OxyMCs OxyAs DNAgs DNAts DNAas DNAts DNAts OxyTs OxyAs OxyAs OxyA |
| 926 | 213613 | 213630 | AACAGAAGTGG TGTTTAA | ASO-1042 | OxyAs OxyAs OxyAs OxyMCs OxyAs DNAgs DNAts DNAas DNAgs DNAts DNAgs DNAts DNAts OxyTs OxyAs OxyAs OxyA |
| 927 | 213926 | 213944 | TGGTTATAAATT CTTCCAG | ASO-1043 | OxyTs DNAgs DNAgs DNAts DNAts DNAts DNAas DNAts DNAas DNAas DNAts DNAts DNAts OxyMCs OxyAs OxyG |
| 928 | 213927 | 213944 | TGGTTATAAATT CTTCCA | ASO-1044 | OxyTs OxyGs DNAgs DNAts DNAts DNAts DNAas DNAts DNAas DNAas DNAts DNAts DNAts OxyMCs OxyMCs OxyA |
| 929 | 213927 | 213945 | CTGGTTATAAA TTCTTCCA | ASO-1045 | OxyMCs DNAts DNAgs DNAgs DNAts DNAts DNAts DNAas DNAts DNAas DNAas DNAts DNAts OxyTs OxyMCs OxyMCs OxyA |
| 930 | 213927 | 213946 | CCTGGTTATAA ATTCTTCCA | ASO-1046 | OxyMCs DNAcs DNAts DNAgs DNAgs DNAts DNAts DNAts DNAts DNAas DNAts DNAas DNAas DNAts DNAts OxyTs OxyMCs OxyMCs OxyA |
| 931 | 213928 | 213945 | CTGGTTATAAA TTCTTCC | ASO-1047 | OxyMCs DNAts DNAgs DNAgs DNAts DNAts DNAts DNAts DNAas DNAts DNAas DNAas OxyTs OxyTs OxyMCs OxyMC |
| 932 | 213928 | 213946 | CCTGGTTATAA ATTCTTCC | ASO-1048 | OxyMCs DNAcs DNAts DNAgs DNAgs DNAts DNAts DNAts DNAts DNAas DNAts DNAas DNAas OxyTs OxyTs OxyMCs OxyMC |
| 933 | 213929 | 213946 | CCTGGTTATAA ATTCTTC | ASO-1049 | OxyMCs OxyMCs DNAts DNAgs DNAgs DNAts DNAts DNAts DNAts DNAas DNAts DNAas DNAas OxyTs OxyTs OxyMC |
| 934 | 213929 | 213947 | TCCTGGTTATA AATTCTTC | ASO-1050 | OxyTs OxyMCs OxyMCs DNAts DNAgs DNAgs DNAts DNAts DNAts DNAts DNAas DNAts DNAas DNAas OxyTs OxyTs OxyMC |
| | 213929 | 213948 | TTCCTGGTTAT | ASO- | OxyTs OxyTs OxyMCs OxyMCs DNAts DNAgs DNAgs DNAts DNAts DNAts DNAts DNAts DNAas DNAts DNAas DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 935 | 213930 | 213947 | AAATTCTTC | ASO-1051 | DNAas DNAas DNAts DNAts DNAcs OxyTs OxyTs OxyMC |
| 936 | 213930 | 213947 | TCCTGGTTATA AATTCTT | ASO-1052 | OxyTs OxyMCs OxyMCs DNAts DNAgs DNAts DNAts DNAas DNAts DNAas DNAts DNAas DNAts DNAts OxyMCs OxyTs OxyT |
| 937 | 213930 | 213948 | TTTCCTGGTTAT AAATTCTT | ASO-1053 | OxyTs OxyTs OxyMCs DNAas DNAts DNAgs DNAts DNAts DNAts DNAas DNAas DNAts DNAas DNAts OxyMCs OxyTs OxyT |
| 938 | 213930 | 213949 | TTTCCTGGTTA TAAATTCTT | ASO-1054 | OxyTs OxyTs OxyTs OxyMCs DNAcs DNAts DNAgs DNAgs DNAts DNAts OxyMCs OxyTs OxyT |
| 939 | 213931 | 213948 | TTCCTGGTTAT AAATTCT | ASO-1055 | OxyTs OxyTs OxyMCs OxyMCs DNAts DNAgs DNAgs DNAts DNAts OxyMCs OxyT |
| 940 | 213931 | 213949 | TTTCCTGGTTA TAAATTCT | ASO-1056 | OxyTs OxyTs OxyTs OxyMCs DNAcs DNAts DNAgs DNAgs DNAts DNAts DNAts OxyTs OxyMCs OxyT |
| 941 | 213931 | 213950 | ATTTCCTGGTT ATAAATTCT | ASO-1057 | OxyAs OxyTs OxyTs DNAcs DNAts DNAas DNAts OxyTs OxyMCs OxyT |
| 942 | 213932 | 213948 | TTCCTGGTTAT AAATTC | ASO-1058 | OxyTs OxyTs OxyMCs OxyAs DNAts DNAas OxyAs OxyTs OxyTs OxyMC |
| 943 | 213932 | 213949 | TTTCCTGGTTA TAAATTC | ASO-1059 | OxyTs OxyTs OxyTs OxyMCs DNAcs DNAts DNAgs DNAgs DNAts DNAts OxyTs OxyMC |
| 944 | 213932 | 213950 | ATTTCCTGGTT ATAAATTC | ASO-1060 | OxyAs OxyTs OxyTs OxyTs DNAcs DNAts DNAas OxyAs OxyTs OxyTs OxyMC |
| 945 | 213932 | 213951 | CATTCCTGGT TATAAATTC | ASO-1061 | OxyMCs OxyAs OxyTs OxyTs DNAcs DNAts DNAgs DNAts DNAts OxyTs OxyMC |
| 946 | 213933 | 213951 | CATTCCTGGT TATAAATT | ASO-1062 | OxyMCs OxyAs OxyTs OxyTs DNAts DNAas OxyAs OxyAs OxyTs OxyT |
| 947 | 213933 | 213952 | TCATTCCTGG TTATAAATT | ASO-1063 | OxyTs OxyMCs OxyAs OxyTs OxyTs DNAts DNAas OxyAs OxyAs OxyTs OxyT |
| 948 | 213934 | 213951 | CATTCCTGGT TATAAAT | ASO-1064 | OxyMCs OxyAs OxyTs OxyTs DNAts DNAcs DNAts DNAas OxyAs OxyAs OxyT |
| 949 | 213934 | 213952 | TCATTCCTGG TTATAAAT | ASO-1065 | OxyTs OxyMCs OxyAs OxyTs OxyTs DNAts DNAcs DNAts DNAas OxyAs OxyT |
| 950 | 214149 | 214165 | CACTGTGTA TACCCT | ASO-1066 | OxyMCs DNAas DNAts DNAas DNAts OxyAs OxyAs OxyMCs OxyT |
| 951 | 214152 | 214169 | CACTCACTGTC TGTATAC | ASO-1067 | OxyMCs OxyAs DNAcs DNAts DNAgs DNAts DNAts DNAts OxyAs OxyMC |
| 952 | 214152 | 214170 | ACACTCACTGT CTGTATAC | ASO-1068 | OxyAs OxyMCs OxyAs DNAcs DNAts DNAgs DNAts DNAts DNAts DNAts OxyAs DNAgs |
| 953 | 214153 | 214169 | CACTCACTGTC TGTATA | ASO-1069 | OxyMCs OxyAs OxyMCs DNAts DNAcs DNAts DNAas DNAts DNAts DNAgs DNAts |
|  | 214159 | 214175 | AGCTTACACTC | ASO- | OxyAs DNAgs DNAts DNAts DNAts DNAcs DNAas DNAts DNAcs DNAts DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 954 | 214160 | 214176 | ACTGTC AAGCTTACACT CACTGT | 1070 ASO-1071 | DNAas DNAcs DNAgs DNAts OxyTs OxyMC OxyAs OxyAs OxyGs DNAcs DNAts DNAas DNAts DNAas DNAcs DNAts DNAas DNAcs DNAts OxyGs OxyT |
| 955 | 214163 | 214178 | CCAAGCTTACA CTCAC | ASO-1072 | OxyMCs OxyMCs OxyAs OxyAs DNAgs DNAcs DNAts DNAas DNAcs DNAas DNAcs DNAts DNAcs DNAcs OxyAs OxyMC |
| 956 | 214279 | 214295 | GCATTACTCAC CTTCAG | ASO-1073 | OxyGs OxyMCs DNAas DNAts DNAas DNAcs DNAts DNAas DNAcs DNAas DNAcs DNAts DNAts DNAcs OxyAs OxyG |
| 957 | 214433 | 214451 | TAGAGATGAAA TAAGAGAG | ASO-1074 | OxyTs OxyAs OxyAs OxyGs OxyAs DNAgs DNAas DNAts DNAgs DNAas DNAts DNAas DNAgs OxyAs OxyGs OxyG |
| 958 | 214766 | 214784 | TAATGTTAAGG GAAAGAGA | ASO-1075 | OxyTs OxyAs OxyAs OxyTs DNAgs DNAts DNAas DNAts DNAas DNAgs DNAas OxyGs OxyAs OxyGs OxyA |
| 959 | 214967 | 214984 | TAAGGGTATCA GTAGGCA | ASO-0071 | OxyTs OxyAs OxyAs DNAgs DNAgs DNAas DNAts DNAas DNAts DNAcs DNAas DNAgs OxyMCs OxyA |
| 960 | 214969 | 214984 | TAAGGGTATCA GTAGG | ASO-1076 | OxyTs OxyAs OxyAs OxyGs DNAgs DNAts DNAas DNAas DNAts DNAcs DNAas OxyGs OxyG |
| 961 | 215349 | 215367 | GACTGGAAATA TGGATTTA | ASO-1077 | OxyGs OxyAs OxyMCs OxyTs DNAgs DNAgs DNAas OxyTs OxyTs OxyA DNAas DNAts DNAgs DNAas DNAts DNAts DNAas DNAts |
| 962 | 215705 | 215724 | ATATATGTTCA CTTAAAAGG | ASO-1078 | OxyAs OxyTs OxyAs OxyTs DNAas DNAts DNAgs DNAts DNAts DNAcs DNAas DNAcs DNAts DNAas OxyAs OxyGs OxyG |
| 963 | 215706 | 215724 | ATATATGTTCA CTTAAAAG | ASO-1079 | OxyAs OxyTs OxyAs OxyTs DNAas DNAts DNAgs DNAts DNAts DNAcs DNAas OxyAs OxyAs OxyG |
| 964 | 216351 | 216370 | ATCATGGGTAT AAAAGGCAC | ASO-1080 | OxyAs DNAts DNAcs DNAas DNAts DNAgs DNAgs DNAgs OxyGs OxyMCs OxyAs OxyMC |
| 965 | 216411 | 216429 | TTTAACTTTACT ATATGG | ASO-1081 | OxyTs OxyTs OxyTs OxyAs DNAas DNAcs DNAts DNAts DNAas DNAcs OxyTs OxyGs OxyG |
| 966 | 216786 | 216802 | ATGTACTTTTG GTTGAC | ASO-1082 | OxyAs OxyTs OxyGs DNAts DNAas DNAcs DNAts DNAts DNAts DNAgs OxyAs OxyMC |
| 967 | 216889 | 216906 | ATAGTGATCTT TATTCTG | ASO-1083 | OxyAs OxyTs OxyAs OxyGs DNAts DNAgs DNAas DNAts DNAcs DNAts DNAts OxyMCs OxyTs OxyG |
| 968 | 217509 | 217528 | TTACAGGCTTT TAATTCATC | ASO-1084 | OxyTs OxyTs OxyAs OxyMCs OxyAs DNAgs DNAas DNAts DNAts DNAts DNAas DNAcs OxyTs OxyMC |
| 969 | 217513 | 217530 | CTTTACAGGCT TTAATT | ASO-1085 | OxyMCs OxyTs OxyTs OxyTs DNAas DNAcs DNAas DNAgs DNAgs DNAcs OxyTs OxyT |
| 970 | 217809 | 217828 | ATTTTATTCTTC TTTGTCTC | ASO-1086 | OxyAs OxyTs OxyTs OxyTs DNAts DNAas DNAts DNAts DNAcs DNAts DNAts DNAcs OxyTs OxyMC |
| 971 | 218208 | 218225 | TTCACAAATAT CCAACAC | ASO-1087 | OxyTs OxyMCs OxyAs OxyMCs DNAas DNAas DNAas DNAts DNAas DNAts DNAcs DNAcs OxyAs OxyMC |
| 972 | 218211 | 218228 | CAATTCACAAA | ASO- | OxyMCs OxyAs OxyAs OxyTs DNAts DNAcs DNAas DNAcs DNAas DNAas DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 973 | 218876 | 218893 | CCAGATTGTTG TTCATGA | ASO-1088 | DNAas DNAts DNAts DNAts OxyMCs OxyMCs OxyAs OxyA |
| 974 | 218981 | 218997 | TTCTGAATAGG GCTAA | ASO-1089 | OxyMCs DNAcs DNAts DNAgs DNAts DNAts DNAgs DNAts DNAts DNAgs DNAts DNAcs OxyAs OxyTs OxyGs OxyA |
| 975 | 219839 | 219857 | TATTCCATTCCT GTTTATT | ASO-1090 | OxyTs OxyTs OxyMCs DNAts DNAgs DNAgs OxyMCs OxyTs OxyAs OxyA |
| 976 | 219917 | 219936 | TATGTGCTATA AGTTTGCAA | ASO-1091 | OxyTs OxyAs OxyTs DNAts DNAcs DNAgs DNAts DNAts DNAas OxyTs OxyT |
| 977 | 219976 | 219992 | TGTGTGGAATT AATGCC | ASO-0072 | OxyTs OxyAs DNAts DNAgs DNAts DNAgs DNAcs DNAts DNAts OxyGs OxyMCs OxyAs OxyA |
| 978 | 220130 | 220147 | TCTGTCACTTA TCTTTTG | ASO-1092 | OxyTs DNAgs DNAts DNAgs DNAts DNAgs DNAas DNAts DNAts OxyMCs OxyMC |
| 979 | 220732 | 220751 | TTGGGAGATAA AATAACTCA | ASO-1093 | OxyTs OxyMCs DNAts DNAgs DNAts DNAcs DNAas DNAcs DNAts DNAts OxyTs OxyG |
| 980 | 220735 | 220752 | CTTGGGAGATA AATAAC | ASO-1094 | OxyTs OxyTs OxyGs OxyGs DNAgs DNAas DNAts DNAas DNAts DNAas DNAts OxyMCs OxyA |
| 981 | 220916 | 220933 | CAACAACCATT TATAGCA | ASO-1095 | OxyMCs OxyTs OxyGs OxyTs OxyGs DNAgs DNAas DNAcs DNAgs DNAas OxyTs OxyAs OxyAs OxyMC |
| 982 | 220916 | 220934 | TCAACAACCAT TTATAGCA | ASO-1096 | OxyMCs OxyAs OxyAs DNAas DNAts DNAas DNAcs DNAts DNAts DNAgs DNAts DNAcs DNAcs DNAts OxyA |
| 983 | 220917 | 220934 | TCAACAACCAT TTATAGC | ASO-1097 | OxyTs OxyMCs DNAas DNAcs DNAgs DNAts DNAts DNAts DNAts DNAts DNAas OxyMCs OxyMCs OxyA |
| 984 | 220917 | 220935 | GTCAACAACCA TTTATAGC | ASO-1098 | OxyTs OxyMCs OxyAs OxyAs DNAas DNAts DNAts DNAts DNAts DNAas OxyGs OxyMC |
| 985 | 220917 | 220936 | TGTCAACAACC ATTTATAGC | ASO-1099 | OxyGs OxyTs OxyMCs DNAts DNAas DNAas DNAts DNAts DNAas OxyGs OxyMC |
| 986 | 220918 | 220935 | GTCAACAACCA TTTATAG | ASO-1100 | OxyTs DNAgs DNAts DNAcs DNAts DNAts DNAas DNAts DNAts DNAcs DNAts DNAas OxyGs OxyGs OxyMC |
| 987 | 220918 | 220936 | TGTCAACAACC ATTTATAG | ASO-1101 | OxyGs OxyTs OxyMCs DNAts DNAgs DNAts DNAcs DNAts DNAts DNAts OxyAs OxyG |
| 988 | 220918 | 220937 | GTGTCAACAAC CATTTATAG | ASO-1102 | OxyTs OxyGs OxyTs OxyMCs DNAts DNAcs DNAts DNAts DNAts OxyAs OxyG |
| 989 | 220919 | 220936 | TGTCAACAACC ATTTATA | ASO-1103 | OxyGs DNAts DNAgs DNAts DNAcs DNAas DNAts DNAts DNAts OxyXs OxyAs OxyG |
| 990 | 220919 | 220937 | GTGTCAACAAC CATTTATA | ASO-1104 | OxyTs OxyGs OxyTs OxyMCs DNAts DNAcs DNAas DNAts DNAts DNAts OxyTs OxyA |
| 991 | 221023 | 221041 | AGGTTGGTTTT | ASO-1105 | OxyAs OxyGs OxyGs OxyTs DNAts DNAgs DNAgs DNAts DNAts DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 992 | 221024 | 221041 | TAAATAGA | 1106 | DNAts DNAas DNAas DNAts DNAas OxyGs OxyA |
| 993 | 221141 | 221158 | AGGTTGGTTTT TAAATAG | ASO-1107 | OxyAs DNAas OxyGs DNAts DNAts DNAgs DNAts DNAts DNAts DNAas DNAas OxyAs OxyTs OxyAs OxyG |
| 994 | 221558 | 221575 | TTTAATATTTGT AACTTG | ASO-1108 | OxyTs OxyTs OxyTs OxyAs DNAas DNAts DNAts DNAts DNAgs DNAts DNAas DNAas OxyMCs OxyTs OxyTs OxyG |
| 995 | 221765 | 221784 | ATTTGCTACTAT TCCACT | ASO-1109 | OxyAs DNAts DNAts DNAts DNAgs DNAas DNAts DNAas DNAcs DNAts DNAas DNAts DNAts DNAcs OxyMCs OxyAs OxyMCs OxyT |
| 997 | 221991 | 222007 | CATTTATTCTAA TTTTCCTG | ASO-1110 | DNAas DNAts DNAts DNAts DNAts DNAts DNAts DNAts DNAcs DNAcs OxyTs OxyG |
| 998 | 222173 | 222189 | TTAGGATGATG AGTTTA | ASO-1113 | OxyTs OxyTs OxyAs OxyGs DNAgs DNAas DNAts DNAgs DNAas DNAts DNAgs DNAas DNAts DNAts OxyTs OxyTs OxyA |
| 999 | 222645 | 222664 | AAGGCAGGGTT ATTTGA | ASO-1114 | OxyAs DNAas OxyAs OxyGs DNAcs DNAas DNAts DNAts DNAts OxyGs OxyA |
| 1000 | 222658 | 222674 | CTAATTCTTTCT TCACTTTC | ASO-1115 | OxyMCs DNAts DNAas DNAts DNAcs DNAts DNAcs OxyTs OxyTs OxyTs OxyMC |
| 1001 | 223316 | 223335 | ATGGTTGATTC TAATTC | ASO-1116 | OxyAs OxyTs OxyGs OxyGs DNAts DNAgs DNAas DNAts DNAts OxyTs OxyMC |
| 1002 | 223476 | 223493 | TCATTTTGTTTA TATGTTAA | ASO-1117 | OxyTs OxyMCs OxyAs OxyTs DNAts DNAts DNAgs OxyTs OxyTs OxyAs OxyA |
| 1003 | 223778 | 223794 | GATAAATATATT GGGTTA | ASO-1118 | OxyGs OxyAs OxyTs OxyAs DNAas DNAts DNAgs OxyGs OxyTs OxyTs OxyA |
| 1004 | 223903 | 223920 | TGATTCAGAGC ATTACT | ASO-1119 | OxyTs OxyGs OxyAs DNAts DNAcs DNAas OxyMCs OxyT |
| 1005 | 223903 | 223921 | GTCTTTAAGAA TCTGTTT | ASO-1120 | OxyGs OxyTs OxyMCs OxyTs DNAts DNAts DNAas OxyTs OxyTs OxyT |
| 1006 | 223903 | 223922 | TGTCTTTAAGA ATCTGTTT | ASO-1121 | OxyTs OxyGs OxyTs OxyMCs DNAts DNAts DNAgs OxyTs OxyTs OxyT |
| 1007 | 223904 | 223921 | CTGTCTTTAAG AATCTGTTT | ASO-1122 | OxyMCs OxyTs OxyGs DNAcs DNAts DNAcs DNAts DNAgs OxyTs OxyT |
| 1008 | 223904 | 223922 | TGTCTTTAAGA ATCTGTT | ASO-1123 | OxyTs OxyGs OxyTs DNAcs DNAts DNAts DNAts OxyGs OxyT |
| 1009 | 223904 | 223923 | CTGTCTTTAAG AATCTGTT | ASO-1124 | OxyMCs OxyTs OxyGs DNAts DNAcs DNAts DNAts DNAts OxyGs OxyT |
| 1010 | 223905 | 223922 | GCTGTCTTTAA GAATCTGTT | ASO-1125 | OxyGs DNAcs DNAts DNAgs DNAts DNAts DNAcs DNAts DNAts DNAts OxyGs OxyT |
| 1011 | 223905 | 223923 | CTGTCTTTAAG AATCTGT | ASO-1126 | OxyMCs DNAgs DNAas DNAas DNAts OxyMCs DNAts DNAts DNAts OxyGs OxyT |
| | | | GCTGTCTTTAA | ASO- | OxyGs OxyMCs DNAts DNAgs DNAas DNAts DNAts DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1012 | 223906 | 223923 | GAATCTGT | 1127 | DNAas DNAgs OxyMCs DNAas DNAts DNAcs DNAts OxyGs OxyT |
| 1013 | 223968 | 223987 | GCTGTCTTTAAGAATCTG | ASO-1128 | OxyGs OxyMCs DNAts DNAgs DNAas DNAts DNAcs DNAts DNAts DNAgs DNAas DNAts OxyMCs OxyTs OxyG |
| 1014 | 223969 | 223987 | TCAATGTTTCCAAACAATTT | ASO-1129 | OxyTs OxyMCs OxyAs OxyAs DNAts DNAcs DNAgs DNAts DNAts DNAcs DNAts DNAcs DNAas OxyAs OxyTs OxyTs OxyT |
| 1015 | 223970 | 223987 | TCAATGTTTCCAAACAATT | ASO-1130 | OxyTs OxyMCs OxyAs OxyAs DNAts DNAcs DNAgs DNAts DNAcs DNAcs OxyAs OxyAs OxyTs OxyT |
| 1016 | 224012 | 224030 | TCAATGTTTCCAAACAAT | ASO-1131 | OxyTs OxyMCs OxyAs OxyAs DNAts DNAcs DNAgs DNAts DNAts DNAcs OxyMCs OxyAs OxyAs OxyT |
| 1017 | 224015 | 224031 | TTAACTTCAAGAGTTTGGA | ASO-0073 | OxyTs DNAts DNAas DNAas DNAcs DNAts DNAcs DNAts OxyTs OxyGs OxyGs OxyA |
| 1018 | 224056 | 224073 | GTTAACTTCAAGAGTTT | ASO-1132 | OxyGs OxyTs OxyTs OxyAs DNAas DNAcs DNAts DNAts DNAcs DNAas OxyTs OxyTs OxyT |
| 1019 | 224397 | 224413 | CTACAGACATTTGGCAAA | ASO-1133 | OxyMCs OxyTs DNAts DNAgs DNAas OxyMCs OxyAs OxyAs OxyA |
| 1020 | 224468 | 224485 | ATTTTACAGGATTAGGG | ASO-1134 | OxyAs OxyTs OxyTs DNAts DNAas DNAts DNAas OxyAs OxyGs OxyG |
| 1021 | 224468 | 224487 | GCTTTATTTAGAAAGAAA | ASO-1135 | OxyGs OxyMCs OxyTs OxyTs DNAts DNAas DNAts DNAts DNAas OxyAs OxyA |
| 1022 | 224469 | 224487 | AGGCTTTATTAGAAAGAAA | ASO-1136 | OxyAs OxyGs OxyGs OxyMCs DNAts DNAts DNAts DNAas DNAgs OxyAs OxyAs OxyA |
| 1023 | 224469 | 224488 | AGGCTTTATTAGAAAGAA | ASO-1137 | OxyAs OxyGs OxyGs OxyMCs DNAts DNAts DNAts DNAas DNAcs DNAts OxyAs OxyGs OxyAs OxyA |
| 1024 | 224470 | 224487 | CAGGCTTTATTAGAAAGAA | ASO-1138 | OxyMCs OxyAs OxyGs OxyGs OxyMCs DNAts DNAts DNAts DNAas DNAcs DNAts OxyAs OxyGs OxyAs OxyA |
| 1025 | 224470 | 224488 | AGGCTTTATTTAGAAAGA | ASO-1139 | OxyAs OxyGs OxyGs OxyMCs DNAts DNAts DNAts DNAas DNAas OxyGs OxyA |
| 1026 | 224470 | 224489 | CAGGCTTTATTAGAAAGA | ASO-1140 | OxyMCs OxyAs OxyGs OxyGs OxyMCs DNAts DNAts DNAts DNAas DNAas OxyGs OxyA |
| 1027 | 224471 | 224489 | TCAGGCTTTATTAGAAAGA | ASO-1141 | OxyTs OxyMCs OxyAs OxyGs OxyGs OxyMCs DNAts DNAts DNAts DNAas DNAcs OxyAs OxyGs OxyA |
| 1028 | 224471 | 224490 | TCAGGCTTTATTAGAAAG | ASO-1142 | OxyTs OxyMCs OxyAs OxyGs OxyGs OxyMCs DNAts DNAts DNAts DNAas DNAcs DNAts OxyAs OxyGs OxyG |
| 1029 | 224472 | 224490 | CTCAGGCTTTATTTAGAAAG | ASO-1143 | OxyMCs OxyTs DNAcs DNAas DNAts DNAts DNAts DNAts OxyAs OxyAs OxyG |
| 1030 | 224472 | 224491 | CTCAGGCTTTATTTAGAAA | ASO-1144 | OxyMCs OxyMCs OxyTs OxyMCs DNAas DNAts DNAts DNAts DNAts DNAas OxyAs OxyA |
| | 224472 | | TCTCAGGCTTT | ASO- | OxyTs OxyMCs DNAts DNAcs DNAas DNAgs DNAgs DNAcs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1031 | 224473 | 224490 | ATTTAGAAA | 1145 | DNAts DNAas DNAts DNAts DNAts DNAas OxyGs OxyAs OxyAs OxyA |
| 1032 | 224473 | 224491 | CTCAGGCTTTA TTTAGAA | ASO-1146 | OxyMCs OxyTs OxyAs DNAas DNAcs DNAts DNAts DNAts DNAts DNAas DNAts DNAts DNAts DNAas DNAgs OxyAs OxyA |
| 1033 | 224473 | 224492 | TCTCAGGCTTT ATTTAGAA | ASO-1147 | OxyTs OxyMCs DNAts DNAas DNAts DNAgs DNAgs DNAcs DNAts DNAts DNAas DNAts DNAts DNAts OxyAs OxyGs OxyAs OxyA |
| 1033 | 224473 | 224492 | TTCTCAGGCTT TATTTAGAA | ASO-1148 | OxyTs DNAts DNAas DNAts DNAcs DNAts DNAgs DNAgs DNAcs DNAts DNAts DNAts DNAas DNAts OxyAs OxyGs OxyAs OxyA |
| 1034 | 224474 | 224491 | TCTCAGGCTTT ATTTAGA | ASO-1149 | OxyTs OxyMCs DNAts DNAcs DNAts DNAgs DNAgs DNAcs DNAts DNAts DNAts DNAas DNAts OxyAs OxyGs OxyA |
| 1035 | 224474 | 224492 | TTCTCAGGCTT TATTTAGA | ASO-1150 | OxyTs DNAts DNAas DNAts DNAcs DNAts DNAgs DNAgs DNAcs DNAts DNAts DNAts DNAas DNAts OxyAs OxyGs OxyA |
| 1036 | 224474 | 224493 | ATTCTCAGGCT TTATTTAGA | ASO-1151 | OxyAs DNAts DNAas DNAts DNAcs DNAts DNAas DNAts DNAgs DNAgs DNAcs DNAts DNAts DNAts OxyAs OxyGs OxyA |
| 1037 | 224475 | 224491 | TCTCAGGCTTT ATTTAG | ASO-1152 | OxyTs OxyMCs DNAts DNAcs DNAts DNAas DNAts DNAgs DNAgs DNAcs DNAts DNAts DNAts OxyAs OxyG |
| 1038 | 224475 | 224492 | TTCTCAGGCTT TATTTAG | ASO-1153 | OxyTs OxyTs OxyMCs DNAts DNAcs DNAts DNAas DNAts DNAgs DNAgs DNAcs DNAts DNAts DNAts OxyAs OxyG |
| 1039 | 224475 | 224493 | ATTCTCAGGCT TTATTTAG | ASO-1154 | OxyAs OxyTs OxyTs OxyMCs DNAts DNAcs DNAts DNAas DNAts DNAgs DNAgs DNAcs DNAts DNAts DNAts OxyAs OxyG |
| 1040 | 224475 | 224494 | AATTCTCAGGC TTTATTTAG | ASO-1155 | OxyAs OxyAs OxyTs DNAts DNAas DNAts DNAcs DNAts DNAas DNAts DNAgs DNAgs DNAcs DNAts OxyTs OxyAs OxyG |
| 1041 | 224476 | 224493 | ATTCTCAGGCT TTATTA | ASO-1156 | OxyAs OxyTs OxyTs OxyMCs DNAts DNAas DNAts DNAcs DNAts DNAas DNAts DNAgs DNAgs DNAcs OxyTs OxyTs OxyA |
| 1042 | 224476 | 224494 | AATTCTCAGGC TTTATTA | ASO-1157 | OxyAs OxyAs OxyTs DNAts DNAcs DNAts DNAas DNAts DNAgs DNAgs DNAcs OxyTs OxyTs OxyA |
| 1043 | 224476 | 224495 | AAATTCTCAGG CTTTATTA | ASO-1158 | OxyAs OxyAs OxyAs OxyTs DNAts DNAcs DNAts DNAas DNAts DNAas DNAgs DNAgs DNAcs DNAts OxyTs OxyTs OxyA |
| 1044 | 224477 | 224496 | CAAATTCTCAG GCTTTATT | ASO-1159 | OxyMCs OxyAs OxyAs OxyAs OxyAs OxyTs DNAts DNAcs DNAts DNAas DNAts DNAas DNAgs DNAgs OxyTs OxyTs OxyT |
| 1045 | 224478 | 224495 | AAATTCTCAGG CTTTATT | ASO-1160 | OxyAs OxyAs OxyAs OxyAs OxyTs DNAts DNAcs DNAts DNAas DNAts DNAas DNAgs DNAgs OxyTs OxyT |
| 1046 | 224478 | 224496 | CAAATTCTCAG GCTTTATT | ASO-1161 | OxyMCs OxyAs OxyAs OxyAs OxyAs OxyTs DNAts DNAas DNAts DNAcs DNAts DNAas DNAts DNAgs OxyTs OxyT |
| 1047 | 224549 | 224565 | TTGAACTTCTAT GGCTA | ASO-1162 | OxyTs DNAts DNAgs DNAas OxyGs OxyMCs OxyTs DNAts DNAas DNAcs DNAts DNAts DNAcs DNAts OxyTs OxyA |
| 1048 | 224549 | 224566 | CTTGAACTTCT ATGGCTA | ASO-1163 | OxyMCs DNAts DNAts DNAgs DNAas DNAcs DNAts DNAts DNAcs DNAts OxyMCs OxyTs OxyA |
| 1049 | 224549 | 224567 | CCTTGAACTTC | ASO- | OxyMCs DNAcs DNAts DNAas DNAcs DNAts DNAts DNAcs DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1050 | 224550 | 224566 | TATGGCTA | 1164 | DNAcs DNAts DNAts DNAgs DNAgs DNAcs OxyTs OxyA |
| 1051 | 224551 | 224567 | CTTGAACTTCT ATGGCT | ASO-1165 | OxyMCs DNAts DNAts DNAgs DNAas DNAas DNAts DNAts DNAcs DNAts DNAts DNAgs OxyGs OxyMCs OxyT |
| 1052 | 224579 | 224595 | CCTTGAACTTC TATGGC | ASO-1166 | OxyMCs DNAcs DNAts DNAts DNAgs DNAas DNAas DNAcs DNAts DNAts DNAts DNAts DNAas DNAts OxyGs OxyGs OxyMC |
| 1053 | 224689 | 224705 | CTACTCACCAA ACCACG | ASO-1167 | OxyMCs DNAts DNAas DNAcs OxyMCs DNAas DNAcs DNAts DNAas DNAcs OxyAs OxyMCs OxyG |
| 1054 | 225058 | 225077 | AGTCAAATTGT TATTAG | ASO-1168 | DNAas DNAas DNAcs OxyAs OxyGs OxyTs OxyMCs DNAas DNAts DNAts DNAts DNAts DNAts OxyTs OxyAs OxyG |
| 1055 | 225260 | 225277 | ACTAAGGTGAA ATATACACA | ASO-1169 | OxyAs OxyMCs OxyTs DNAas DNAas DNAgs DNAgs DNAas DNAts DNAas DNAts DNAas OxyMCs OxyAs OxyMCs OxyA |
| 1056 | 225546 | 225562 | TATGAAAATTAA TGAGTA | ASO-1170 | OxyTs OxyAs OxyTs OxyGs DNAas DNAas DNAas DNAts DNAas DNAts DNAas OxyGs OxyTs OxyA |
| 1057 | 225899 | 225916 | AGGGAGATGTG GTGAAT | ASO-1171 | OxyAs OxyGs OxyGs DNAas DNAgs DNAas DNAts DNAgs DNAts DNAgs DNAts DNAcs DNAts OxyAs OxyT |
| 1058 | 226280 | 226298 | ATATTCTTTCTG TGTTAA | ASO-1172 | OxyAs OxyTs OxyAs OxyTs DNAts DNAts DNAas DNAas DNAts DNAts DNAts DNAcs DNAts OxyAs OxyA |
| 1059 | 226469 | 226488 | TGTTTTACTGTA ATAGAAA | ASO-1173 | OxyTs OxyGs OxyTs OxyTs DNAts DNAts DNAas DNAts DNAts DNAts DNAas DNAgs DNAts OxyAs OxyA |
| 1060 | 226603 | 226619 | CATCTTCTATA CTTCTACTG | ASO-1174 | OxyMCs OxyAs DNAts DNAcs DNAts DNAts DNAcs DNAts DNAts DNAas DNAts DNAcs DNAts OxyTs OxyG |
| 1061 | 227119 | 227138 | TGTCTGATCTG TATGTT | ASO-1175 | OxyTs OxyGs OxyTs OxyMCs DNAts DNAgs DNAts DNAas DNAts DNAts DNAgs DNAts OxyTs OxyT |
| 1062 | 227325 | 227342 | GAAGAAGTGTT TATTATCCC | ASO-1176 | OxyGs DNAas DNAas DNAgs DNAas DNAas DNAts DNAts DNAts DNAts OxyMCs OxyMC |
| 1063 | 227695 | 227713 | TATGTACTTTTA TTTGGA | ASO-1177 | OxyTs OxyAs OxyTs OxyGs DNAts DNAas DNAcs DNAts DNAts DNAts DNAas OxyA |
| 1064 | 227751 | 227768 | TAAAACATGCC TTTACTCC | ASO-1178 | OxyTs DNAas DNAas DNAas DNAcs DNAas DNAts DNAgs DNAcs OxyTs OxyMCs OxyMC |
| 1065 | 227969 | 227987 | TGGGACTATAA TGGCAGA | ASO-0074 | OxyTs DNAgs DNAgs DNAgs DNAas OxyMCs OxyAs DNAts DNAas OxyGs OxyA |
| 1066 | 228060 | 228078 | ATTATCTATTAT GTTGTTT | ASO-1179 | OxyAs OxyAs OxyAs OxyAs DNAts DNAcs DNAts DNAts DNAas DNAts DNAts OxyGs OxyTs OxyT |
| 1067 | 228387 | 228405 | TGAAAAGTAAA TATGGGAA | ASO-1180 | OxyTs OxyGs OxyAs OxyAs DNAas DNAas DNAts DNAas DNAas DNAgs DNAts OxyGs OxyGs OxyA |
| 1068 | 228875 | 228893 | AGAAAAGAGAA TTACTGAC | ASO-1181 | OxyAs OxyGs DNAas DNAts DNAas DNAas DNAas DNAgs DNAas DNAas DNAcs OxyTs OxyGs OxyAs OxyMC |
| | | | GATTTCAATAA | ASO- | OxyGs OxyAs OxyTs OxyTs DNAts DNAts DNAts DNAts DNAcs DNAas DNAas DNAts DNAas DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1069 | 228887 | 228906 | CTTAGAAT | 1182 | DNAcs DNAts DNAts DNAas OxyGs OxyAs OxyAs OxyT |
| 1070 | 229468 | 229484 | TTTAATAATGTA TGATTTCA | ASO-1183 | OxyTs OxyTs OxyAs DNAas DNAts DNAas DNAts DNAgs DNAts DNAas DNAts DNAgs DNAas DNAts OxyTs OxyTs OxyMCs OxyA |
| 1071 | 229629 | 229646 | TTGGTAGTTGT GAGGTA | ASO-1184 | OxyTs DNAts DNAgs DNAgs OxyGs OxyGs OxyTs OxyA DNAgs DNAas OxyGs OxyGs OxyTs OxyA |
| 1072 | 230078 | 230096 | TCTTTTCTATTA CCATTC | ASO-1185 | OxyTs OxyMCs OxyTs OxyTs DNAts DNAts DNAcs DNAas DNAts DNAas OxyTs OxyTs OxyMC DNAas DNAcs DNAcs OxyAs OxyTs OxyTs OxyMC |
| 1073 | 230562 | 230579 | AACTAGATGGG GAAAGAAA | ASO-1186 | OxyAs OxyAs OxyMCs OxyTs DNAas DNAgs DNAas DNAgs DNAas DNAts OxyAs OxyAs OxyA DNAgs DNAgs DNAas DNAas DNAas OxyGs OxyAs OxyAs OxyA |
| 1074 | 230564 | 230582 | TGAAATGGGAA ACTAAGA | ASO-1187 | OxyTs OxyGs OxyAs OxyAs DNAas DNAts DNAas DNAgs DNAas DNAas DNAas DNAas OxyAs OxyGs OxyA |
| 1075 | 230705 | 230722 | ATATGAAATGG GAAACTAA | ASO-1188 | OxyAs OxyTs OxyAs OxyTs DNAgs DNAas DNAas DNAas DNAts DNAgs DNAgs DNAas OxyMCs OxyTs OxyAs OxyA |
| 1076 | 230706 | 230723 | AATTGCTTACC ACATGCC | ASO-1189 | OxyAs OxyAs DNAts DNAts DNAgs DNAcs DNAts DNAts DNAas DNAcs DNAas OxyMCs OxyMC |
| 1077 | 230706 | 230723 | TAATTGCTTAC CACATGC | ASO-1190 | OxyTs OxyAs OxyAs OxyTs DNAts DNAgs DNAcs DNAts DNAts DNAas DNAcs DNAas DNAts OxyGs OxyMC |
| 1078 | 230706 | 230724 | ATAATTGCTTA CCACATGC | ASO-1191 | OxyAs DNAts DNAas DNAas DNAts DNAts DNAgs DNAcs DNAts DNAts DNAas DNAcs DNAas OxyTs OxyGs OxyMC |
| 1079 | 230706 | 230725 | TATAATTGCTTA CCACATGC | ASO-1192 | OxyTs OxyAs DNAts DNAas DNAas DNAts DNAts DNAgs DNAcs DNAts DNAts DNAas DNAcs DNAas OxyGs OxyMC |
| 1080 | 230707 | 230723 | TAATTGCTTAC CACATG | ASO-1193 | OxyTs OxyAs OxyAs DNAts DNAts DNAgs DNAcs DNAts DNAts DNAas DNAcs DNAas OxyTs OxyG |
| 1081 | 230707 | 230724 | ATAATTGCTTA CCACATG | ASO-1194 | OxyAs OxyTs OxyAs OxyAs DNAts DNAts DNAgs DNAcs DNAts DNAts DNAas DNAcs DNAas OxyTs OxyG |
| 1082 | 230707 | 230725 | TATAATTGCTTA CCACATG | ASO-1195 | OxyTs OxyAs DNAts DNAas DNAas DNAts DNAts DNAgs DNAcs DNAts DNAts DNAas OxyMCs OxyAs OxyTs OxyG |
| 1083 | 230707 | 230726 | ATATAATTGCTT ACCACATG | ASO-1196 | OxyAs OxyTs OxyAs OxyTs DNAas DNAas DNAts DNAts DNAgs DNAcs DNAts DNAts DNAas OxyMCs OxyAs OxyTs OxyG |
| 1084 | 230708 | 230724 | ATAATTGCTTA CCACAT | ASO-1197 | OxyAs OxyTs OxyAs OxyAs DNAts DNAts DNAgs DNAcs DNAts DNAts DNAas OxyMCs OxyAs OxyT |
| 1085 | 230708 | 230725 | TATAATTGCTTA CCACAT | ASO-1198 | OxyTs OxyAs OxyTs OxyAs OxyAs DNAts DNAts DNAgs DNAcs DNAts DNAts DNAas OxyMCs OxyAs OxyT |
| 1086 | 230708 | 230726 | ATATAATTGCTT ACCACAT | ASO-1199 | OxyAs OxyTs OxyAs OxyTs DNAas DNAas DNAts DNAts DNAgs DNAcs DNAts DNAts DNAas OxyMCs OxyAs OxyT |
| 1087 | 230708 | 230727 | AATATAATTGCT TACCACAT | ASO-1200 | OxyAs OxyAs OxyTs OxyAs OxyTs DNAas DNAas DNAts DNAts DNAgs DNAcs DNAts DNAts DNAas OxyMCs OxyAs OxyT |
| 1088 | 230709 | 230725 | TATAATTGCTTA | ASO- | OxyTs OxyTs OxyAs OxyTs DNAas DNAas DNAts DNAts DNAgs DNAcs DNAts DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1088 | 230709 | 230726 | CCACA | 1201 | DNAas DNAcs OxyMCs OxyAs OxyMCs OxyA |
| 1089 | 230709 | 230726 | ATATAAATTGCTT ACCACA | ASO-1202 | OxyAs OxyTs OxyAs DNAts DNAas DNAts DNAgs DNAcs DNAts DNAas DNAcs OxyMCs OxyAs OxyMCs OxyA |
| 1090 | 230709 | 230727 | AATATAAATTGCT ACCACA | ASO-1203 | OxyAs OxyAs OxyTs OxyAs DNAts DNAaas OxyMCs OxyAs OxyMCs OxyA DNAts DNAts DNAas DNAcs OxyMCs OxyAs OxyMCs OxyA |
| 1091 | 230709 | 230728 | AAATATAAATTG CTTACCACA | ASO-1204 | OxyAs OxyAs OxyAs OxyTs DNAas DNAts DNAas DNAts DNAgs DNAcs DNAts DNAas DNAcs OxyAs OxyMCs OxyA |
| 1092 | 230709 | 230726 | ATATAAATTGCTT ACCAC | ASO-1205 | OxyAs OxyTs OxyAs OxyTs DNAas DNAas DNAts DNAgs DNAcs DNAts DNAts DNAas OxyMCs OxyAs OxyMC |
| 1093 | 230710 | 230727 | AATATAAATTGCT TACCAC | ASO-1206 | OxyAs OxyAs OxyTs OxyAs DNAts DNAaas DNAts DNAaas OxyMCs OxyAs OxyMC DNAts DNAts DNAas OxyMCs OxyAs OxyMC |
| 1094 | 230710 | 230728 | AAATATAAATTG CTTACCAC | ASO-1207 | OxyAs OxyAs OxyAs OxyTs DNAas DNAts DNAas DNAts DNAas OxyMCs OxyAs OxyMC |
| 1095 | 230710 | 230729 | AAAATATAAATTG CTTACCAC | ASO-1208 | OxyAs OxyAs OxyAs OxyAs OxyTs DNAas DNAts DNAas OxyMCs OxyAs OxyMC DNAgs DNAcs DNAts DNAas OxyMCs OxyAs OxyMC |
| 1096 | 230711 | 230728 | AAATATAAATTG CTTACCA | ASO-1209 | OxyAs OxyAs OxyAs OxyTs DNAas DNAts DNAaas OxyMCs OxyAs OxyMC DNAcs DNAts DNAts DNAas OxyMCs OxyAs OxyMC |
| 1097 | 230711 | 230730 | CAAAATATAAATT GCTTACCA | ASO-1210 | OxyMCs OxyAs OxyAs OxyAs OxyTs DNAas DNAts DNAas OxyMCs OxyAs OxyA DNAts DNAts DNAas DNAts DNAaas OxyMCs OxyAs OxyMC |
| 1098 | 230712 | 230730 | CAAAATATAAATT GCTTACC | ASO-1211 | OxyMCs OxyAs OxyAs OxyAs OxyTs DNAas DNAts DNAas OxyMCs OxyAs OxyMC DNAts DNAts DNAas OxyMCs OxyAs OxyMC |
| 1099 | 231315 | 231331 | TTTGGTAGGAT GGAGGC | ASO-1212 | OxyTs DNAts DNAts DNAaas DNAgs DNAaas OxyGs OxyMC DNAgs DNAaas OxyGs OxyGs OxyMC |
| 1100 | 231437 | 231455 | GATGTTCAACT TGTATTT | ASO-1213 | OxyGs OxyAs OxyTs OxyGs DNAts DNAts DNAas DNAts DNAaas OxyTs OxyT DNAts DNAgs DNAts DNAaas DNAts OxyTs OxyT |
| 1101 | 231724 | 231742 | TCAGATTTTGT AGTATTA | ASO-1214 | OxyTs OxyMCs OxyAs DNAgs DNAaas DNAts DNAts DNAts DNAgs DNAts OxyAs OxyA DNAts DNAts DNAaas OxyTs OxyTs OxyTs OxyA |
| 1102 | 232138 | 232157 | TTTTCCAATATT TACTAGTT | ASO-1215 | OxyTs OxyTs OxyTs OxyTs DNAcs DNAcs DNAaas OxyAs OxyTs OxyT DNAaas DNAts DNAts DNAaas DNAcs DNAts DNAaas OxyTs OxyT |
| 1103 | 232143 | 232161 | ATTATTTTCCAA TATTTAC | ASO-1216 | OxyAs OxyTs OxyTs OxyAs DNAts DNAts DNAts DNAts DNAcs DNAcs DNAaas OxyAs OxyMC |
| 1104 | 232577 | 232593 | AAGTAGTGATG ATGAAT | ASO-1217 | OxyAs OxyAs OxyAs OxyGs OxyGs DNAts DNAaas DNAgs DNAts DNAgs DNAaas OxyAs OxyT |
| 1105 | 233040 | 233059 | TAGATTTGAAC AAAGATATT | ASO-0075 | OxyTs OxyAs OxyGs OxyAs DNAts DNAts DNAts DNAgs DNAaas OxyAs OxyTs OxyT DNAaas DNAts DNAts DNAaas DNAgs DNAaas OxyAs OxyT |
| 1106 | 233042 | 233059 | TAGATTTGAAC AAAGATA | ASO-1218 | OxyTs OxyAs OxyGs OxyAs DNAts DNAts DNAts DNAgs DNAaas OxyAs OxyTs OxyA DNAaas DNAts DNAts DNAaas DNAts DNAgs DNAaas OxyT |
| | 233443 | 233459 | ATAGGAAGGAA | ASO- | OxyAs OxyAs OxyTs OxyAs DNAgs DNAaas DNAgs DNAgs DNAaas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1107 | 233828 | 233844 | ACTAGG | 1219 | DNAas DNAas DNAcs OxyTs OxyAs OxyGs OxyG |
| 1108 | 234122 | 233844 | GAATTTGGTAT TCAGGT | ASO-1220 | OxyGs OxyAs OxyTs DNAts DNAts DNAgs DNAts DNAgs DNAts DNAcs DNAas OxyGs OxyGs OxyT |
| 1109 | 234373 | 234141 | CATTTATGGGG TATAATATG | ASO-1221 | OxyMCs OxyAs OxyTs DNAts DNAts DNAas DNAts DNAgs DNAgs DNAgs DNAts DNAas DNAas OxyTs OxyAs OxyTs OxyG |
| 1110 | 234379 | 234390 | TGATATTTGTTC TATTGT | ASO-1222 | OxyTs OxyGs OxyAs DNAts DNAas DNAts DNAts DNAts DNAgs DNAts DNAcs DNAts DNAas DNAas OxyTs OxyTs OxyGs OxyT |
| 1111 | 235164 | 234397 | TTTATTTTGATA TTTGTTC | ASO-1223 | OxyTs OxyTs OxyTs OxyAs DNAts DNAts DNAts DNAts DNAgs DNAas DNAas DNAts DNAts DNAts OxyGs OxyTs OxyTs OxyMC |
| 1112 | 235255 | 235183 | ATAGTGTGTTT TGTGAGTCT | ASO-1224 | OxyAs DNAts DNAts DNAgs DNAts DNAgs DNAts DNAgs DNAts DNAgs DNAts DNAts OxyMCs OxyMCs OxyT |
| 1113 | 235523 | 235271 | AAAGGTTAGAT ATATGA | ASO-1225 | OxyAs DNAts DNAts OxyAs OxyGs DNAgs DNAts DNAts DNAas DNAas DNAas DNAts OxyGs OxyA |
| 1114 | 235870 | 235540 | TATAAGTTTCTA AGGAGT | ASO-1226 | OxyTs OxyAs OxyTs DNAas DNAts DNAgs OxyGs OxyAs OxyGs OxyT |
| 1115 | 236126 | 235888 | GATATATAATAA AATGGTA | ASO-1227 | OxyGs OxyAs OxyTs OxyAs DNAts DNAts DNAts OxyAs DNAts OxyGs OxyGs OxyTs OxyA |
| 1116 | 236409 | 236143 | TTTGTTTTCTGA GTAGTG | ASO-1228 | OxyTs OxyTs OxyTs OxyGs DNAts DNAts DNAts DNAgs OxyTs OxyG |
| 1117 | 236658 | 236427 | ATTAATGTTTAT TATTTGC | ASO-1229 | OxyAs OxyTs OxyTs OxyAs DNAas DNAts OxyTs OxyTs OxyGs OxyMC |
| 1118 | 237019 | 236675 | AGAAAAGTAGC AAGACAA | ASO-1230 | OxyAs DNAas DNAgs OxyAs OxyMCs OxyAs OxyA |
| 1119 | 237093 | 237035 | TGAACTGAAGA CTGTTG | ASO-1231 | OxyTs OxyGs OxyAs OxyAs DNAcs DNAts OxyTs OxyG |
| 1120 | 237101 | 237112 | GTAGAGAAATT TAAGACAGT | ASO-0076 | OxyGs OxyTs OxyAs OxyGs DNAas DNAas DNAas DNAas DNAcs OxyGs OxyT |
| 1121 | 237723 | 237119 | AGTAAATGTAG AGAAATTT | ASO-1232 | OxyAs OxyGs OxyTs OxyAs DNAts DNAgs DNAas DNAas DNAts DNAts DNAas DNAgs OxyTs OxyTs OxyT |
| 1122 | 237726 | 237742 | TAAGTGAACAG TTTTGTAGT | ASO-1233 | OxyTs OxyGs OxyAs OxyAs OxyGs DNAts DNAgs DNAas DNAcs DNAas DNAas OxyGs OxyT |
| 1123 | 238473 | 237744 | TTTAAGTGAAC AGTTTTGT | ASO-1234 | OxyTs OxyTs OxyTs OxyAs DNAas DNAts DNAts DNAgs OxyTs OxyGs OxyT |
| 1124 | 238476 | 238492 | CACATGACATT AAATTGTAC | ASO-1235 | OxyMCs OxyAs OxyMCs OxyAs DNAts DNAts DNAas DNAgs DNAas DNAts DNAts OxyAs DNAts DNAts OxyMC |
| 1125 | 238988 | 238493 | ACACATGACAT TAAATTG | ASO-1236 | OxyAs OxyAs OxyMCs OxyMCs OxyAs DNAts DNAas DNAts DNAts OxyGs OxyAs DNAas DNAcs DNAas |
|  |  | 239004 | GTATTTGGTGT | ASO- | OxyGs DNAts DNAas DNAts DNAts DNAts DNAgs DNAgs DNAgs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1126 | 238992 | 239008 | GATGGTATTTGGTGTGG | ASO-1237 | DNAgs DNAgs DNAts OxyGs OxyGs OxyG |
| 1127 | 239707 | 239725 | AGGAGAGAATGAAGAAGGAA | ASO-1238 | OxyGs OxyAs OxyTs DNAgs DNAgs DNAts DNAas DNAts DNAts DNAgs DNAgs DNAts DNAgs DNAts OxyGs OxyG |
| 1128 | 240013 | 240032 | AGTATTCTCTCATTTTATG | ASO-1239 | OxyAs OxyGs OxyGs DNAas DNAgs DNAas DNAgs DNAas OxyGs OxyAs OxyA |
| 1129 | 240243 | 240260 | GAGAGGATAAATAGGAAA | ASO-1240 | OxyAs DNAgs DNAts DNAas DNAts DNAts DNAts OxyAs OxyTs OxyG |
| 1130 | 240554 | 240570 | CCTGCATCTGTTAATAT | ASO-1241 | DNAcs DNAas DNAgs DNAgs OxyGs OxyAs OxyAs OxyA |
| 1131 | 240766 | 240785 | ATTATTTATTTATTTTCCTC | ASO-1242 | OxyMCs OxyMCs DNAts DNAgs DNAas DNAts DNAcs DNAts DNAgs DNAts DNAas DNAgs OxyTs OxyAs OxyT |
| 1132 | 241923 | 241941 | GTGTTGTCTAACTGAGAGA | ASO-1243 | OxyAs OxyTs OxyTs OxyAs DNAts DNAts DNAts DNAcs OxyMCs OxyTs OxyMC |
| 1133 | 241976 | 241994 | TTTTCTTTATCTATGAACT | ASO-1244 | OxyGs DNAts DNAgs DNAgs DNAgs OxyAs OxyGs OxyA |
| 1134 | 242356 | 242373 | CCTGATGTGAAATTGTCA | ASO-1245 | OxyTs OxyTs OxyTs DNAcs DNAts DNAas OxyAs OxyMCs OxyT |
| 1135 | 242729 | 242748 | GTAATAGTGATAGTTTCCAT | ASO-1246 | OxyMCs OxyMCs DNAts DNAas DNAts DNAgs DNAts DNAgs DNAts DNAgs DNAas OxyTs OxyMCs OxyA |
| 1136 | 242869 | 242887 | ATGAAAATGATGATAGTAA | ASO-0077 | OxyGs DNAts DNAas DNAas DNAts DNAts DNAgs DNAts DNAas OxyMCs OxyMCs OxyAs OxyT |
| 1137 | 243066 | 243083 | GTTTAATCATCTTAGAAT | ASO-1247 | OxyAs OxyTs OxyGs OxyAs DNAas DNAts DNAts OxyGs OxyTs OxyAs OxyA |
| 1138 | 243824 | 243842 | TTTGTTGAGTGATGGTATC | ASO-1248 | OxyGs OxyTs OxyTs DNAts DNAas OxyGs OxyAs OxyAs OxyT |
| 1139 | 244141 | 244159 | ATTGTAGGAAAACTTCAGA | ASO-1249 | OxyTs OxyTs DNAgs DNAts DNAgs DNAts DNAgs DNAgs DNAts DNAgs OxyTs OxyMC |
| 1140 | 244265 | 244284 | ATAGAGAATGACACCTGGAG | ASO-1250 | OxyAs OxyTs OxyTs DNAgs DNAts DNAts OxyMCs OxyAs OxyGs OxyA |
| 1141 | 244266 | 244284 | ATAGAGAATGACACCTGGAG | ASO-1251 | OxyAs DNAgs DNAas DNAts DNAgs DNAgs DNAcs OxyGs OxyGs OxyAs OxyG |
| 1142 | 244266 | 244285 | TATAGAGAATGACACCTGGA | ASO-1252 | OxyAs DNAts DNAts DNAcs DNAcs DNAcs DNAts OxyGs OxyGs OxyA |
| 1143 | 244267 | 244286 | ATATAGAGAATGACACCTGG | ASO-1253 | OxyTs OxyAs DNAts DNAts DNAts DNAts OxyGs OxyGs OxyA |
| 1144 | 244268 | 244286 | ATATAGAGAATGACACCTGG | ASO-1254 | OxyAs DNAts DNAts DNAts DNAas DNAcs DNAts OxyGs OxyGs OxyG |
| | | | ATATAGAGAAT | ASO- | OxyAs OxyTs DNAts DNAas DNAts DNAts DNAas DNAgs DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1145 | 244268 | 244287 | GACACCTG | 1255 | DNAgs DNAas DNAcs DNAas OxyMCs OxyAs DNAas DNAcs DNAgs DNAas OxyTs OxyG |
| 1146 | 244269 | 244287 | AATATAGAGAA TGACACCTG | 1256 | OxyAs DNAas OxyTs DNAas DNAcs DNAas DNAgs DNAas OxyMCs OxyAs DNAas DNAcs DNAgs DNAas OxyTs OxyG |
| 1147 | 244269 | 244286 | ATATAGAGAAT GACACCT | 1257 | OxyAs OxyTs OxyAs DNAts DNAas DNAgs DNAas OxyAs OxyMCs OxyAs DNAas DNAcs DNAgs DNAas OxyTs OxyT |
| 1148 | 244269 | 244287 | AATATAGAGAA TGACACCT | 1258 | OxyAs OxyAs OxyTs OxyAs DNAts DNAas DNAcs OxyAs DNAas OxyAs OxyMCs OxyT |
| 1149 | 244269 | 244288 | GAATATAGAGA ATGACACCT | 1259 | DNAts DNAas DNAts DNAgs DNAas DNAcs DNAas DNAgs DNAas OxyMCs OxyT |
| 1150 | 244270 | 244286 | ATATAGAGAAT GACACC | 1260 | OxyAs OxyTs DNAas DNAgs DNAas DNAcs DNAas DNAgs DNAas DNAts DNAgs DNAas OxyMC |
| 1151 | 244270 | 244287 | AATATAGAGAA TGACACC | 1261 | OxyAs OxyAs OxyTs OxyAs DNAts DNAas OxyMCs OxyAs OxyMCs OxyMC |
| 1152 | 244270 | 244288 | GAATATAGAGA ATGACACC | 1262 | OxyGs OxyAs OxyAs OxyTs DNAas DNAts DNAas OxyMCs OxyAs OxyMCs OxyAs DNAgs DNAas OxyMC |
| 1153 | 244270 | 244289 | AGAATATAGAG AATGACACC | 1263 | OxyAs OxyGs DNAas DNAts DNAgs DNAas DNAts DNAas OxyMCs OxyAs OxyMCs OxyMC |
| 1154 | 244271 | 244288 | GAATATAGAGA ATGACAC | 1264 | OxyGs OxyAs OxyAs OxyTs DNAas DNAts DNAas DNAts DNAgs OxyAs OxyMC |
| 1155 | 244271 | 244290 | TAGAATATAGA GAATGACAC | 1265 | OxyTs OxyAs OxyGs OxyAs DNAas DNAts DNAgs OxyAs DNAas OxyAs OxyMC |
| 1156 | 244274 | 244291 | GTAGAATATAG AGAATGA | 1266 | OxyGs OxyTs OxyAs OxyGs DNAas OxyAs OxyTs OxyGs OxyA |
| 1157 | 244351 | 244367 | ACATCATAAGC TCCAGC | 1267 | DNAas DNAgs DNAts DNAcs DNAas OxyGs DNAas DNAgs DNAcs DNAas DNAgs OxyMC |
| 1158 | 244351 | 244368 | TACATCATAAG CTCCAGC | 1268 | OxyTs DNAas DNAcs DNAas OxyGs DNAas DNAts DNAas DNAas DNAcs DNAas DNAgs OxyMC |
| 1159 | 244351 | 244369 | ATACATCATAA GCTCCAGC | 1269 | OxyAs DNAts DNAas DNAcs DNAas OxyAs DNAts DNAcs DNAas DNAcs DNAas OxyGs OxyMC |
| 1160 | 244352 | 244369 | ATACATCATAA GCTCCAG | 1270 | OxyAs DNAs OxyTs DNAas DNAcs DNAas DNAcs DNAas DNAts DNAcs OxyMCs OxyAs OxyG |
| 1161 | 244352 | 244370 | CATACATCATA AGCTCCAG | 1271 | OxyMCs DNAas DNAts DNAas DNAcs DNAas DNAts DNAas DNAgs DNAcs OxyAs DNAts |
| 1162 | 244352 | 244371 | ACATACATCAT AAGCTCCAG | 1272 | OxyAs OxyMCs OxyAs DNAts DNAcs DNAas DNAts DNAcs DNAas DNAcs OxyAs OxyG |
| 1163 | 244353 | 244369 | ATACATCATAA GCTCCA | 1273 | OxyAs OxyTs DNAts DNAcs DNAas DNAts DNAcs OxyMCs OxyMCs OxyA |
| | 244353 | 244370 | CATACATCATA | ASO- | OxyMCs OxyAs DNAts DNAcs DNAas DNAts DNAcs DNAas DNAcs DNAas DNAts DNAcs DNAcs DNAAs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1164 | 244353 | 244371 | AGCTCCA | 1274 | DNAas DNAgs DNAcs DNAts OxyMCs OxyA |
| 1165 | 244353 | 244371 | ACATACATCAT AAGCTCCA | ASO-1275 | OxyAs OxyMCs OxyAs DNAts DNAas DNAcs DNAts DNAas DNAts DNAas DNAgs DNAcs DNAts DNAcs OxyMCs OxyA |
| 1166 | 244354 | 244372 | TACATACATCA TAAGCTCCA | ASO-1276 | OxyTs OxyAs DNAcs DNAas DNAgs DNAcs DNAts DNAas DNAts DNAas DNAts DNAas DNAgs DNAcs DNAts DNAcs OxyMCs OxyA |
| 1167 | 244354 | 244370 | CATACATCATA AGCTCC | ASO-1277 | OxyMCs OxyAs DNAts DNAas DNAgs DNAcs DNAts DNAas DNAts DNAas DNAgs DNAcs OxyTs OxyMC |
| 1168 | 244354 | 244371 | ACATACATCAT AAGCTCC | ASO-1278 | DNAas DNAas DNAgs OxyMCs OxyTs DNAas DNAgs DNAcs OxyTs OxyMCs OxyMC |
| 1169 | 244354 | 244372 | TACATACATCA TAAGCTCC | ASO-1279 | OxyTs OxyAs DNAcs DNAas DNAgs DNAcs DNAts DNAas DNAts DNAas DNAgs DNAcs OxyTs OxyMC |
| 1170 | 244354 | 244373 | TTACATACATC ATAAGCTCC | ASO-1280 | OxyTs DNAts DNAas DNAcs DNAas DNAgs DNAcs DNAts DNAas DNAts DNAas DNAgs DNAcs OxyTs OxyMC |
| 1171 | 244355 | 244371 | ACATACATCAT AAGCTC | ASO-1281 | OxyAs OxyMCs OxyAs DNAts DNAas OxyGs OxyMCs OxyTs OxyMC |
| 1172 | 244355 | 244372 | TACATACATCA TAAGCTC | ASO-1282 | OxyTs OxyAs OxyMCs OxyAs DNAts DNAas DNAgs OxyMCs OxyTs OxyMC |
| 1173 | 244355 | 244373 | TTACATACATC ATAAGCTC | ASO-1283 | OxyTs OxyAs OxyAs OxyMCs DNAas DNAas DNAgs DNAcs OxyTs OxyMC |
| 1174 | 244356 | 244374 | ATTACATACAT CATAAGCTC | ASO-1284 | OxyAs DNAts DNAas DNAcs DNAas DNAgs OxyGs OxyMCs OxyTs OxyMC |
| 1175 | 244356 | 244373 | TTACATACATC ATAAGCT | ASO-1285 | OxyTs OxyTs DNAas DNAcs DNAas OxyAs OxyGs OxyMCs OxyT |
| 1176 | 244356 | 244374 | ATTACATACAT CATAAGCT | ASO-1286 | OxyAs DNAts DNAas DNAcs DNAas OxyAs OxyGs OxyMCs OxyT |
| 1177 | 244357 | 244375 | TATTACATACAT CATAAGCT | ASO-1287 | OxyTs OxyAs DNAts DNAats DNAas OxyAs OxyGs OxyMCs OxyT |
| 1178 | 244357 | 244373 | TTACATACATC ATAAGC | ASO-1288 | OxyTs OxyTs OxyAs OxyMCs DNAas DNAas DNAts OxyAs OxyGs OxyMC |
| 1179 | 244357 | 244374 | ATTACATACAT CATAAGC | ASO-1289 | OxyAs OxyTs OxyTs OxyAs DNAts DNAas OxyAs OxyAs OxyGs OxyMC |
| 1180 | 244357 | 244375 | TATTACATACAT CATAAGC | ASO-1290 | OxyTs OxyAs OxyTs OxyTs DNAts DNAas OxyAs OxyAs OxyGs OxyMC |
| 1181 | 244358 | 244376 | TTATTACATACA TCATAAGC | ASO-1291 | OxyTs OxyTs OxyAs OxyTs OxyTs DNAts DNAas OxyAs OxyAs OxyGs OxyMC |
| 1182 | 244358 | 244375 | TATTACATACAT CATAAG | ASO-1292 | OxyTs OxyAs OxyTs OxyTs DNAts DNAcs DNAas OxyTs OxyAs OxyG |
| | 244358 | 244376 | TTATTACATACA | ASO- | OxyTs OxyTs OxyAs OxyTs DNAts DNAas DNAcs DNAas DNAts DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1183 | 244358 | 244377 | TCATAAG | 1293 | DNAas DNAts DNAcs DNAats OxyTs OxyAs OxyAs OxyG |
| 1184 | 244359 | 244377 | GTTATTACATA CATCATAAG | ASO-1294 | OxyGs OxyTs OxyTs OxyAs DNAts DNAts DNAcs DNAas DNAts DNAas DNAcs DNAts DNAcs DNAAs OxyTs OxyAs OxyG |
| 1185 | 244359 | 244377 | GTTATTACATA CATCATAA | ASO-1295 | OxyGs OxyTs OxyTs OxyAs DNAts DNAcs DNAas DNAcs DNAts DNAas DNAcs OxyTs OxyAs OxyA |
| 1186 | 244359 | 244378 | AGTTATTACATA CATCATAA | ASO-1296 | OxyAs OxyGs OxyTs OxyTs DNAas DNAts DNAts DNAcs DNAas DNAcs DNAts DNAas OxyTs OxyAs OxyA |
| 1187 | 244360 | 244377 | GTTATTACATA CATCATA | ASO-1297 | OxyGs OxyTs OxyTs OxyAs DNAts DNAts DNAcs DNAas DNAcs DNAts OxyAs OxyT OxyA |
| 1188 | 244360 | 244378 | AGTTATTACATA CATCATA | ASO-1298 | OxyAs OxyGs OxyTs DNAts DNAas DNAts DNAts DNAcs DNAas DNAcs DNAts OxyAs OxyTs OxyA |
| 1189 | 244360 | 244379 | TAGTTATTACAT ACATCATA | ASO-1299 | OxyTs OxyAs OxyGs OxyTs DNAts DNAas DNAts DNAcs DNAas DNAcs OxyAs OxyTs OxyA |
| 1190 | 244361 | 244379 | TAGTTATTACAT ACATCAT | ASO-1300 | OxyTs OxyAs OxyGs OxyTs DNAts DNAas DNAts DNAts OxyMCs OxyAs OxyT |
| 1191 | 244361 | 244380 | ATAGTTATTACA TACATCAT | ASO-1301 | OxyAs OxyTs OxyAs OxyGs DNAts DNAts DNAas DNAts DNAts OxyMCs OxyAs OxyT |
| 1192 | 244362 | 244379 | TAGTTATTACAT ACATCA | ASO-1302 | OxyTs OxyAs OxyGs OxyTs DNAts DNAas DNAts DNAts OxyMCs OxyA |
| 1193 | 244362 | 244380 | ATAGTTATTACA TACATCA | ASO-1303 | OxyAs OxyTs OxyAs OxyGs OxyGs DNAts DNAas DNAts DNAcs DNAas DNAts OxyMCs OxyA |
| 1194 | 244362 | 244381 | AATAGTTATTAC ATACATCA | ASO-1304 | OxyAs OxyAs OxyTs OxyAs DNAGs DNAts DNAcs DNAas DNAts DNAcs OxyTs OxyMCs OxyA |
| 1195 | 244363 | 244380 | ATAGTTATTACA TACATC | ASO-1305 | OxyAs OxyTs OxyAs OxyGs DNAts DNAas DNAts DNAcs DNAas OxyTs OxyTs OxyMC |
| 1196 | 244363 | 244381 | AATAGTTATTAC ATACATC | ASO-1306 | OxyAs OxyAs OxyTs OxyAs DNAgs DNAts DNAcs DNAas DNAts DNAts OxyMCs OxyAs OxyTs OxyMC |
| 1197 | 244363 | 244382 | AAATAGTTATTA CATACATC | ASO-1307 | OxyAs OxyAs OxyAs OxyTs DNAAs DNAgs DNAts DNAcs DNAas DNAts DNAcs OxyAs OxyTs OxyMC |
| 1198 | 244365 | 244383 | TAAATAGTTATT ACATACA | ASO-1308 | OxyTs OxyAs OxyAs OxyAs DNAts DNAas DNAgs DNAts DNAcs DNAas OxyMCs OxyA |
| 1199 | 244365 | 244384 | ATAAATAGTTAT TACATACA | ASO-1309 | OxyAs OxyTs OxyAs OxyAs DNAas DNAts DNAas DNAgs DNAts DNAcs DNAas OxyMCs OxyA |
| 1200 | 244713 | 244732 | TATAATATAAAA TTATGTGA | ASO-1310 | OxyTs OxyAs OxyTs OxyAs DNAas DNAts DNAcs DNAts DNAas OxyGs OxyTs OxyGs OxyA |
| 1201 | 244952 | 244969 | GATTCTGAACT TAATTTA | ASO-1311 | OxyGs OxyAs OxyTs OxyTs DNAcs DNAts DNAgs DNAas DNAts DNAgs DNAts DNAas |
|  | 245416 | 245434 | AAGATGGTGAA | ASO- | OxyAs DNAas DNAas DNAas DNAgs DNAts DNAgs DNAts DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1202 | 245669 | 245686 | TGTGCTAG | ASO-1312 | DNAas DNAts DNAgs DNAts DNAgs OxyMCs OxyTs OxyAs OxyG |
| 1203 | 246287 | 246305 | TTTTAATTCCTG AAGCTT | ASO-1313 | OxyTs OxyTs DNAts DNAts DNAas DNAts DNAts DNAcs DNAts DNAgs DNAas DNAas OxyGs OxyMCs OxyTs OxyT |
| 1204 | 246518 | 246536 | CAAAATGAGGT ATTATATA | ASO-1314 | OxyMCs OxyAs OxyAs DNAts DNAts DNAgs DNAas DNAts DNAgs DNAgs OxyTs OxyAs OxyTs OxyA |
| 1205 | 246523 | 246542 | GAGTATCTGAT AAGGGACC | ASO-1315 | OxyGs OxyAs DNAgs DNAgs DNAts DNAts DNAts DNAts DNAgs DNAas OxyMCs OxyMC |
| 1206 | 246727 | 246746 | ATTAAAGAGTA TCTGATAAG | ASO-0078 | DNAas DNAts DNAts DNAgs DNAts OxyTs OxyAs DNAas DNAgs DNAas OxyTs OxyAs OxyG |
| 1207 | 246773 | 246789 | GTGATGGAAAC TTCAAAAAT | ASO-1316 | OxyGs OxyTs OxyGs OxyAs DNAts DNAgs DNAas DNAas OxyAs OxyAs OxyAs OxyT |
| 1208 | 246773 | 246790 | TTGATGAGGTC TTTGGC | ASO-1317 | OxyTs DNAts DNAgs DNAgs DNAts DNAts OxyGs OxyGs OxyMC |
| 1209 | 246849 | 246865 | ATTGATGAGGT CTTTGGC | ASO-1318 | OxyAs DNAts DNAts DNAgs DNAas DNAts DNAgs OxyGs OxyMC |
| 1210 | 246849 | 246866 | ACTTACACAGA TCCATG | ASO-1319 | OxyAs OxyMCs DNAts DNAts DNAcs DNAas DNAcs DNAas DNAgs |
| 1211 | 246849 | 246867 | TACTTACACAG ATCCATG | ASO-1320 | OxyTs OxyAs OxyMCs OxyTs DNAts DNAas DNAcs DNAas OxyTs OxyG |
| 1212 | 246849 | 246868 | TTACTTACACA GATCCATG | ASO-1321 | OxyTs OxyTs OxyAs OxyAs DNAts DNAas DNAcs DNAas OxyTs OxyG |
| 1213 | 246850 | 246866 | TTTACTTACACA GATCCATG | ASO-1322 | OxyTs DNAts DNAts DNAas DNAts DNAcs OxyAs OxyTs OxyG |
| 1214 | 246850 | 246867 | TACTTACACAG ATCCAT | ASO-1323 | OxyTs OxyAs OxyMCs DNAts DNAas OxyMCs OxyAs OxyT |
| 1215 | 246850 | 246868 | TTACTTACACA GATCCAT | ASO-1324 | OxyTs DNAas DNAts DNAas DNAts DNAas DNAcs DNAas OxyAs OxyT |
| 1216 | 246850 | 246869 | TTTACTTACACA GATCCAT | ASO-1325 | OxyTs OxyTs OxyAs OxyAs DNAts DNAas DNAcs DNAas OxyMCs OxyAs OxyT |
| 1217 | 246851 | 246867 | TTTTACTTACAC AGATCCAT | ASO-1326 | OxyTs OxyTs OxyTs OxyAs DNAts DNAas DNAcs DNAas OxyMCs OxyAs OxyT |
| 1218 | 246851 | 246868 | TTACTTACACA GATCCA | ASO-1327 | OxyTs OxyAs OxyTs DNAts DNAas DNAcs OxyMCs OxyA |
| 1219 | 246851 | 246869 | TTTACTTACACA GATCCA | ASO-1328 | OxyTs OxyTs OxyAs OxyTs DNAts DNAas DNAts DNAas OxyMCs OxyA |
| 1220 | 246851 | 246870 | TTTTACTTACAC AGATCCA | ASO-1329 | OxyTs OxyTs DNAts DNAts DNAas DNAts DNAas OxyTs OxyMCs OxyMCs OxyA |
| | | | GTTTTACTTACA | ASO- | OxyGs OxyTs DNAts DNAts DNAas DNAcs DNAts DNAas DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1221 | 246852 | 246868 | CAGATCCA | ASO-1330 | DNAas DNAcs DNAas DNAgs DNAas DNAcs DNAts DNAcs OxyMCs OxyA |
| 1222 | 246852 | 246868 | TTTTACTTACACA GATCC | ASO-1331 | OxyTs OxyTs OxyAs DNAts DNAas DNAcs DNAts DNAas DNAcs DNAas DNAcs DNAas DNAgs OxyAs OxyTs OxyMCs OxyMC |
| 1222 | 246852 | 246869 | TTTTACTTACAC AGATCC | ASO-1332 | OxyTs OxyTs OxyTs DNAts DNAas DNAcs DNAts DNAas DNAcs DNAas DNAcs DNAas DNAgs OxyAs OxyTs OxyMCs OxyMC |
| 1223 | 246852 | 246870 | GTTTTACTTACA CAGATCC | ASO-1333 | OxyGs OxyTs DNAts DNAts DNAas DNAcs DNAts DNAas DNAcs DNAas DNAcs DNAas DNAgs DNAas OxyTs OxyMCs OxyMC |
| 1224 | 246852 | 246871 | AGTTTTACTTAC ACAGATCC | ASO-1334 | DNAas DNAgs DNAts DNAts DNAts DNAas DNAcs DNAts DNAas DNAcs DNAas DNAcs DNAas DNAgs DNAas OxyTs OxyMCs OxyMC |
| 1225 | 246853 | 246870 | GTTTTACTTACA CAGATC | ASO-1335 | OxyGs OxyTs OxyTs DNAts DNAas DNAcs DNAts DNAas DNAcs DNAas DNAcs DNAas OxyGs OxyAs OxyTs OxyMC |
| 1226 | 246853 | 246871 | AGTTTTACTTAC ACAGATC | ASO-1336 | OxyAs OxyGs OxyTs OxyTs DNAts DNAas DNAcs DNAts DNAas DNAcs DNAas DNAgs DNAas OxyTs OxyMC |
| 1227 | 246853 | 246872 | AAGTTTTACTTA CACAGATC | ASO-1337 | OxyAs OxyAs OxyGs OxyTs DNAts DNAas DNAcs DNAts DNAas DNAcs DNAas DNAgs OxyAs OxyTs OxyMC |
| 1228 | 246854 | 246871 | AGTTTTACTTAC ACAGAT | ASO-1338 | OxyAs OxyGs OxyTs OxyTs DNAts DNAas DNAcs DNAts DNAas DNAcs DNAas DNAcs DNAas OxyGs OxyAs OxyT |
| 1229 | 246854 | 246872 | AAGTTTTACTTA CACAGAT | ASO-1339 | OxyAs OxyAs OxyGs OxyTs DNAts DNAas DNAcs DNAts DNAas DNAcs DNAas DNAgs OxyAs OxyAs OxyT |
| 1230 | 246854 | 246873 | GAAGTTTTACT TACACAGAT | ASO-1340 | OxyGs OxyAs OxyAs DNAgs DNAts DNAts DNAts DNAas DNAcs DNAts DNAas DNAcs DNAas OxyAs OxyGs OxyAs OxyT |
| 1231 | 246855 | 246874 | AGAAGTTTTAC TTACACAGA | ASO-1341 | OxyAs DNAgs DNAas DNAas DNAgs DNAts DNAts DNAts DNAas DNAcs DNAts DNAas OxyMCs OxyAs OxyGs OxyA |
| 1232 | 246856 | 246874 | AGAAGTTTTAC TTACACAG | ASO-1342 | OxyAs OxyGs OxyAs DNAas DNAgs DNAts DNAts DNAts DNAas DNAcs DNAts DNAas OxyMCs OxyAs OxyG |
| 1233 | 246856 | 246875 | GAGAAGTTTTA CTTACACAG | ASO-1343 | OxyGs OxyAs OxyGs DNAas DNAas DNAgs DNAts DNAts DNAts DNAas DNAcs DNAts DNAas OxyMCs OxyAs OxyG |
| 1234 | 246857 | 246875 | GAGAAGTTTTA CTTACACA | ASO-1344 | OxyGs OxyAs OxyGs DNAas DNAas DNAgs DNAts DNAts DNAts DNAas DNAcs DNAts DNAas OxyMCs OxyAs OxyA |
| 1235 | 246858 | 246875 | GAGAAGTTTTA CTTACAC | ASO-1345 | OxyGs OxyAs OxyGs OxyAs DNAas DNAgs DNAts DNAts DNAts DNAas DNAcs DNAts DNAas OxyMCs OxyAs OxyMC |
| 1236 | 247171 | 247188 | AAATCTTTTCTT CTGGGA | ASO-1346 | OxyAs OxyAs DNAts DNAcs DNAts DNAts DNAts DNAts DNAcs DNAts DNAts DNAcs OxyGs OxyGs OxyA |
| 1237 | 247399 | 247415 | GCCTTTCATTT ACTTAG | ASO-1347 | OxyGs OxyMCs DNAcs DNAts DNAts DNAts DNAcs DNAas DNAts DNAts DNAts DNAas OxyMCs DNAts DNAts DNAcs DNAts DNAas OxyG |
| 1238 | 247440 | 247459 | AATTATCTTTAT TTTAATGT | ASO-1348 | OxyAs OxyAs DNAts DNAts DNAas DNAts DNAcs DNAts DNAts DNAts DNAas DNAts DNAts DNAts DNAas OxyTs OxyGs OxyT |
| 1239 | 247882 | 247899 | TTCTAAGTATTC | ASO- | OxyTs OxyTs OxyMCs OxyTs DNAas DNAas DNAgs DNAts DNAas DNAts DNAts DNAcs DNAas DNAts DNAts DNAcs DNAs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1240 | 248013 | 248028 | AATTGC ACAGTAGAACG TTGCT | 1349 | DNAcs DNAas DNAts OxyTs OxyGs OxyMC |
| 1241 | 248013 | 248028 | ACAGTAGAACG TTGCT | ASO-1350 | OxyAs OxyMCs OxyAs DNAgs DNAts DNAas DNAgs DNAas DNAmcs DNAgs DNAts DNAts OxyGs OxyMCs OxyT |
| 1242 | 248014 | 248029 | AACAGTAGAAC GTTGCT | ASO-1351 | OxyAs OxyAs OxyMCs OxyAs DNAgs DNAts DNAas DNAgs DNAas DNAts DNAmcs DNAgs DNAts DNAts OxyGs OxyMCs OxyT |
| 1243 | 248014 | 248029 | AACAGTAGAAC GTTGC | ASO-1352 | OxyAs OxyAs OxyMCs OxyAs DNAgs DNAts DNAas DNAgs DNAas DNAgs DNAts DNAts OxyTs OxyGs OxyMC |
| 1244 | 248015 | 248030 | CAACAGTAGAA CGTTGC | ASO-1353 | DNAmcs DNAgs OxyTs OxyTs OxyGs OxyMC DNAas DNAmcs DNAgs OxyTs OxyTs OxyGs OxyMC |
| 1245 | 248015 | 248030 | CAACAGTAGAA CGTTG | ASO-1354 | OxyMCs OxyAs OxyAs OxyMCs DNAgs DNAts DNAas DNAgs DNAts DNAas DNAgs DNAas DNAts DNAts OxyTs OxyTs OxyG |
| 1246 | 248051 | 248068 | GCAACAGTAGA ACGTTG | ASO-1355 | OxyGs OxyMCs OxyAs OxyAs DNAcs DNAas DNAgs DNAts DNAas DNAgs DNAas DNAmcs DNAgs DNAts DNAts OxyTs OxyTs OxyG |
| 1247 | 248053 | 248069 | CAAGCAGTAGA CAGTCTC | ASO-1356 | OxyMCs OxyAs DNAas DNAgs DNAcs DNAas DNAgs DNAts DNAas DNAcs DNAgs DNAts DNAts OxyTs OxyG |
| 1248 | 248054 | 248070 | TCAAGCAGTCT ACAGTC | ASO-1357 | OxyTs OxyMCs DNAts DNAas DNAas DNAgs DNAcs DNAas DNAgs DNAts DNAas DNAcs DNAts DNAts OxyGs OxyTs OxyMC |
| 1249 | 248054 | 248070 | TTCAAGCAGTC TACAGTC | ASO-1358 | OxyTs DNAts DNAas DNAcs DNAas DNAas DNAgs DNAcs DNAas DNAgs DNAts OxyGs OxyTs OxyMC |
| 1250 | 248055 | 248072 | TTCAAGCAGTC TACAGT | ASO-1359 | OxyTs OxyTs OxyMCs DNAas DNAas DNAgs DNAcs DNAas DNAgs DNAts DNAas DNAcs OxyAs OxyGs OxyT |
| 1251 | 248055 | 248072 | CTTCAAGCAGT CTACAGT | ASO-1360 | OxyMCs DNAts DNAts DNAas DNAas DNAgs DNAcs DNAas DNAgs DNAts DNAas DNAcs DNAts OxyAs OxyGs OxyT |
| 1252 | 248056 | 248074 | TCTTCAAGCAG TCTACAG | ASO-1361 | OxyTs OxyMCs DNAts DNAts DNAas DNAas DNAgs DNAcs DNAas DNAgs DNAts DNAas DNAcs OxyAs OxyG |
| 1253 | 248056 | 248074 | TTTCTTCAAGC AGTCTACAG | ASO-1362 | OxyTs DNAts DNAts DNAts DNAas DNAas DNAgs DNAcs DNAas DNAgs DNAts DNAas DNAcs OxyAs OxyG |
| 1254 | 248055 | 248072 | TCTTCAAGCAG TCTACA | ASO-1363 | OxyTs OxyTs OxyMCs DNAts DNAas DNAas DNAgs DNAcs DNAas DNAgs DNAts DNAas DNAcs OxyMCs OxyA |
| 1255 | 248056 | 248073 | TTCTTCAAGCA GTCTACA | ASO-1364 | OxyTs OxyTs OxyMCs DNAts DNAts DNAas DNAas DNAgs DNAcs DNAas DNAgs DNAts DNAas DNAts DNAas OxyMCs OxyA |
| 1256 | 248056 | 248074 | TTTCTTCAAGC AGTCTACA | ASO-1365 | OxyTs OxyTs OxyTs DNAts DNAts DNAas DNAas DNAgs DNAcs DNAas DNAgs DNAts DNAas OxyMCs OxyA |
| 1257 | 248057 | 248075 | ATTTCTTCAAG CAGTCTACA | ASO-1366 | OxyAs DNAts DNAts DNAts DNAcs DNAts DNAts DNAas DNAas DNAgs DNAcs DNAas DNAgs DNAts DNAas OxyMCs OxyA |
| 1258 | 248057 | 248076 | ATTTCTTCAAG CAGTCTAC | ASO-1367 | OxyAs DNAts DNAts DNAts DNAcs DNAts DNAts DNAas DNAas DNAgs DNAcs DNAas DNAgs DNAts OxyAs OxyMC |
|  | 248057 | 248076 | AATTTCTTCAA | ASO- | OxyAs OxyAs DNAts DNAts DNAts DNAcs DNAts DNAts DNAas DNAas DNAgs DNAcs DNAas DNAgs DNAts DNAts DNAcs DNAs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1259 | 248058 | 248076 | GCAGTCTAC | 1368 | DNAgs DNAcs DNAas DNAgs DNAts DNAcs OxyTs OxyAs OxyMC |
| 1260 | 248060 | 248077 | AATTTCTTCAA GCAGTCTA | 1369 | OxyAs OxyAs OxyTs DNAts DNAts DNAcs DNAts DNAcs DNAas DNAts DNAgs DNAcs DNAas DNAgs DNAcs DNAts OxyTs OxyA |
| 1261 | 248060 | 248077 | AAATTTCTTCAA GCAGTC | 1370 | OxyAs OxyAs DNAas DNAas DNAts DNAts DNAts DNAcs DNAas DNAas DNAgs DNAcs OxyGs OxyTs OxyMC |
| 1261 | 248060 | 248078 | TAAATTTCTTCA AGCAGTC | 1371 | OxyTs DNAas DNAas DNAas DNAts DNAts DNAts DNAcs DNAas OxyAs OxyGs OxyTs OxyMC |
| 1262 | 248060 | 248079 | TTAAATTTCTTC AAGCAGTC | 1372 | OxyTs DNAts DNAas DNAas DNAts DNAts DNAts DNAcs DNAas OxyAs OxyGs OxyTs OxyMC |
| 1263 | 248061 | 248078 | TAAATTTCTTCA AGCAGT | 1373 | OxyTs OxyAs OxyAs DNAas DNAts DNAts DNAts DNAcs DNAts DNAas OxyAs OxyGs OxyT |
| 1264 | 248061 | 248079 | TTAAATTTCTTC AAGCAGT | 1374 | OxyTs DNAts DNAas DNAas DNAts DNAts DNAts DNAcs DNAts DNAas OxyMCs OxyAs OxyGs OxyT |
| 1265 | 248061 | 248080 | ATTAAATTTCTT CAAGCAGT | 1375 | OxyAs OxyTs DNAts DNAas DNAas DNAts DNAts DNAts DNAcs DNAts DNAas DNAgs OxyMCs OxyAs OxyGs OxyT |
| 1266 | 248062 | 248079 | TTAAATTTCTTC AAGCAG | 1376 | OxyTs OxyTs OxyAs OxyAs DNAas DNAts DNAts DNAts DNAcs DNAts DNAas OxyMCs OxyAs OxyG |
| 1267 | 248062 | 248080 | ATTAAATTTCTT CAAGCAG | 1377 | OxyAs OxyTs DNAts DNAas DNAas DNAts DNAts DNAts DNAcs DNAts DNAas OxyMCs OxyAs OxyG |
| 1268 | 248062 | 248081 | CATTAAATTTCT TCAAGCAG | 1378 | OxyMCs OxyAs DNAts DNAts DNAas DNAas DNAts DNAts DNAts DNAcs DNAts DNAas DNAgs OxyMCs OxyAs OxyA |
| 1269 | 248063 | 248080 | ATTAAATTTCTT CAAGCA | 1379 | OxyAs OxyTs DNAts DNAas DNAas DNAts DNAts DNAts DNAcs DNAts DNAas OxyMCs OxyGs OxyA |
| 1270 | 248063 | 248081 | CATTAAATTTCT CAAGCA | 1380 | OxyMCs OxyAs DNAts DNAts DNAas DNAas DNAts DNAts DNAts DNAcs DNAts DNAas OxyMCs OxyGs OxyA |
| 1271 | 248063 | 248082 | GCATTAAATTT CTTCAAGCAG | 1381 | OxyGs OxyMCs DNAas DNAts DNAts DNAas DNAas DNAts DNAts DNAts DNAcs DNAts DNAas DNAgs OxyMCs OxyA |
| 1272 | 248064 | 248081 | CATTAAATTTCT TCAAGC | 1382 | OxyMCs OxyAs DNAts DNAts DNAas DNAas DNAts DNAts DNAts DNAcs DNAts DNAas OxyMCs OxyMC |
| 1273 | 248064 | 248082 | GCATTAAATTT CTTCAAGC | 1383 | OxyGs OxyMCs DNAas DNAts DNAts DNAas DNAas DNAts DNAts DNAts DNAcs DNAts DNAas OxyAs OxyGs OxyMC |
| 1274 | 248064 | 248083 | AGCATTAAATTT CTTCAAGC | 1384 | OxyAs OxyGs OxyMCs DNAas DNAts DNAts DNAas DNAas DNAts DNAts DNAts DNAcs DNAts DNAas OxyAs OxyGs OxyMC |
| 1275 | 248065 | 248082 | GCATTAAATTT CTTCAAG | 1385 | OxyGs OxyMCs OxyAs DNAts DNAts DNAas DNAas DNAts DNAts DNAts DNAcs DNAts DNAas OxyAs OxyG |
| 1276 | 248065 | 248083 | AGCATTAAATTT CTTCAAG | 1386 | OxyAs OxyGs OxyMCs DNAas DNAts DNAts DNAas DNAas DNAts DNAts DNAts DNAcs DNAts DNAas DNAas DNAts |
| 1277 | 248066 | 248083 | AGCATTAAATTT CTTCAAG | ASO- | OxyAs OxyAs OxyGs OxyMCs DNAas DNAts DNAts DNAas DNAas DNAts DNAts DNAts DNAcs DNAts DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1278 | 248079 | 248098 | CTTTAGTTTCT TCTAGCAT | ASO-1387 | DNAts DNAcs DNAts OxyT OxyMCs OxyAs OxyA |
| 1279 | 248080 | 248098 | CTTTAGTTTCT TCTAGCA | ASO-1388 | OxyMCs DNAts DNAts DNAts DNAts DNAgs DNAts DNAts DNAts DNAcs DNAts DNAts DNAts DNAts DNAgs DNAcs OxyAs OxyT |
| 1280 | 248081 | 248098 | CTTTAGTTTCT TCTAGC | ASO-1389 | OxyMCs OxyTs DNAts DNAts DNAts DNAas DNAgs OxyMCs OxyA DNAts DNAts DNAts DNAcs DNAts DNAas DNAgs OxyMCs OxyA |
| 1281 | 248082 | 248099 | CCTTTAGTTTC TTCTAG | ASO-1390 | OxyMCs OxyTs DNAts DNAcs DNAts DNAas OxyGs OxyMC DNAts DNAts DNAcs DNAts DNAts DNAas OxyGs OxyMC |
| 1282 | 248083 | 248100 | ACCTTTAGTTT CTTCTA | ASO-1391 | OxyAs OxyMCs OxyMCs DNAts DNAts DNAcs DNAts DNAas OxyAs OxyG |
| 1283 | 248085 | 248102 | TTACCTTTAGTT TTCTTC | ASO-1392 | OxyAs OxyMCs DNAts DNAts DNAts DNAts DNAas DNAgs DNAts DNAts DNAcs OxyMCs OxyTs OxyA |
| 1284 | 248086 | 248103 | CTTACCTTTAG TTTTCTT | ASO-1393 | OxyTs OxyTs OxyMCs OxyMCs DNAts DNAcs OxyTs OxyTs OxyMC |
| 1285 | 248092 | 248111 | TAAAATTTCTTA CCTTTAGT | ASO-1394 | OxyMCs OxyTs OxyT DNAas DNAts DNAts DNAts OxyMCs OxyTs OxyT |
| 1286 | 248093 | 248111 | TAAAATTTCTTA CCTTTAG | ASO-1395 | OxyTs OxyAs OxyAs DNAas DNAts DNAts DNAts DNAts OxyAs OxyGs OxyT |
| 1287 | 248093 | 248112 | GTAAAATTTCTT ACCTTTAG | ASO-1396 | OxyTs OxyAs OxyAs OxyAs DNAas DNAts DNAts DNAts OxyTs OxyTs OxyAs OxyG |
| 1288 | 248094 | 248112 | GTAAAATTTCTT ACCTTTA | ASO-1397 | OxyGs OxyTs OxyAs OxyAs DNAas DNAts DNAts DNAts OxyTs OxyTs OxyAs OxyG |
| 1289 | 248094 | 248113 | TGTAAAATTTCT TACCTTTA | ASO-1398 | OxyGs OxyTs OxyAs OxyAs DNAas DNAts DNAts DNAts DNAcs OxyTs OxyTs OxyA |
| 1290 | 248095 | 248113 | TGTAAAATTTCT TACCTTT | ASO-1399 | OxyTs OxyGs OxyTs DNAas DNAts DNAts DNAts DNAcs OxyTs OxyTs OxyA |
| 1291 | 248095 | 248114 | ATGTAAAATTTC TTACCTTT | ASO-1400 | OxyTs OxyGs OxyTs DNAas DNAts DNAts DNAts DNAcs OxyMCs OxyTs OxyT |
| 1292 | 248096 | 248114 | ATGTAAAATTTC TTACCTT | ASO-1401 | OxyAs OxyTs OxyGs OxyTs DNAas DNAts DNAts DNAcs OxyTs OxyT |
| 1293 | 248096 | 248115 | AATGTAAAATT CTTACCTT | ASO-1402 | OxyAs OxyTs OxyGs OxyTs DNAts DNAas DNAcs OxyMCs OxyTs OxyT |
| 1294 | 248097 | 248115 | AATGTAAAATT CTTACCT | ASO-1403 | OxyAs OxyAs OxyTs OxyGs DNAts DNAts DNAcs OxyMCs OxyMCs OxyT |
| 1295 | 248097 | 248116 | AAATGTAAAAT TCTTACCT | ASO-1404 | OxyAs OxyAs OxyTs DNAgs DNAts DNAts OxyAs OxyMCs OxyMCs OxyT |
| 1296 | 248098 | 248115 | AATGTAAAATT CTTACC | ASO-1405 | OxyAs OxyAs OxyTs OxyGs DNAts DNAts DNAts DNAts DNAas DNAts DNAcs DNAts DNAts DNAts DNAts DNAas DNAcs OxyMCs OxyT |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1297 | 248098 | 248116 | AAATGTAAAATTCTTACC | ASO-1406 | DNAts DNAcs DNAts OxyT OxyAs OxyMCs OxyMC |
| 1298 | 248181 | 248198 | ACATAATTGAAAGCCTTT | ASO-1407 | OxyAs OxyAs OxyAs OxyTs DNAgs DNAts DNAas DNAas DNAts DNAts DNAts DNAcs DNAts OxyTs OxyAs OxyMCs OxyMC |
| 1299 | 248540 | 248559 | CCCTGTGAAAAAATTAGAA | ASO-1408 | OxyAs OxyMCs OxyMCs OxyAs DNAts DNAas DNAgs DNAcs DNAas OxyMCs OxyTs OxyT |
| 1300 | 248541 | 248560 | ACCCTGTGAAAAAATTAGA | ASO-1409 | OxyMCs OxyMCs OxyMCs OxyAs DNAts DNAgs DNAas DNAas DNAas OxyAs OxyGs OxyA |
| 1301 | 248542 | 248559 | CCCTGTGAAAAAATTAG | ASO-1410 | DNAas OxyAs OxyMCs OxyMCs DNAts DNAgs DNAts DNAts OxyAs OxyGs OxyA |
| 1302 | 248542 | 248560 | ACCCTGTGAAAAAATTAG | ASO-1411 | OxyMCs OxyMCs OxyMCs OxyAs DNAts DNAas DNAgs DNAts DNAas DNAas DNAas OxyTs OxyAs OxyG |
| 1303 | 248542 | 248561 | CACCCTGTGAAAAAATTAG | ASO-1412 | OxyAs OxyAs OxyMCs OxyMCs OxyAs DNAts DNAas DNAas DNAas DNAts DNAgs DNAts OxyAs OxyG |
| 1304 | 248543 | 248560 | ACCCTGTGAAAAAATTA | ASO-1413 | OxyMCs OxyMCs OxyMCs OxyAs DNAts DNAas DNAas DNAts DNAts OxyAs OxyTs OxyA |
| 1305 | 248543 | 248561 | CACCCTGTGAAAAAATTA | ASO-1414 | OxyAs OxyMCs OxyMCs OxyMCs OxyAs DNAts DNAcs DNAts DNAas DNAas DNAas OxyTs OxyA |
| 1306 | 248544 | 248561 | CACCCTGTGAAAAAATT | ASO-1415 | OxyMCs OxyMCs OxyMCs OxyAs DNAts DNAcs DNAas DNAts DNAas DNAas OxyAs OxyTs OxyT |
| 1307 | 248545 | 248562 | GCACCCTGTGAAAAAAT | ASO-1416 | OxyGs OxyMCs OxyAs DNAts DNAas DNAas DNAas OxyAs OxyAs OxyT |
| 1308 | 248563 | 248579 | GCATAGTTGTCAAGATG | ASO-1417 | OxyGs OxyGs OxyMCs DNAts DNAgs DNAts DNAts DNAas OxyGs OxyAs OxyT |
| 1309 | 248563 | 248580 | AGCATAGTTGTCAAGATG | ASO-1418 | OxyAs OxyGs DNAcs DNAas DNAas DNAas OxyGs OxyAs OxyT |
| 1310 | 248563 | 248581 | CAGCATAGTTGTCAAGATG | ASO-1419 | OxyMCs OxyAs OxyGs DNAts DNAgs DNAas DNAgs DNAas OxyGs OxyTs OxyG |
| 1311 | 248564 | 248580 | AGCATAGTTGTCAAGAT | ASO-1420 | OxyAs OxyGs OxyMCs OxyAs DNAts DNAgs DNAas DNAas OxyGs OxyAs OxyT |
| 1312 | 248564 | 248581 | CAGCATAGTTGTCAAGAT | ASO-1421 | OxyAs OxyGs OxyMCs OxyAs DNAts DNAts DNAas OxyGs OxyAs OxyT |
| 1313 | 248565 | 248581 | CAGCATAGTTGTCAAGA | ASO-1422 | OxyMCs OxyAs DNAgs DNAcs DNAas DNAas OxyGs OxyAs OxyT |
| 1314 | 249516 | 249533 | CATGGAATCATTTTGAGG | ASO-1423 | OxyMCs OxyAs DNAts DNAts DNAts DNAts OxyAs OxyGs OxyG |
| 1315 | 249969 | 249985 | ATTGGTTGAAG | ASO-1424 | OxyAs OxyTs OxyTs OxyGs DNAgs DNAts DNAts DNAts DNAgs DNAas DNAcs DNAas DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1316 | 250211 | 250228 | AGCATT | 1425 | DNAas DNAgs OxyMCs OxyAs OxyTs OxyT |
| 1317 | 250538 | 250555 | GTTTATGAAAC AGGTAAC | ASO-1426 | OxyGs OxyTs OxyTs DNAats DNAgs DNAas DNAas DNAcs DNAas DNAgs DNAas OxyTs OxyAs OxyMC |
| 1318 | 250877 | 250895 | TTTTAGTTTACA TGATGA | ASO-1427 | OxyTs OxyTs OxyTs DNAas DNAgs DNAts DNAats DNAas DNAcs DNAas DNAts DNAgs OxyAs OxyTs OxyGs OxyA |
| 1319 | 251031 | 251050 | ATGATTCAGGG TAAGCAGG | ASO-1428 | OxyAs DNAts DNAgs DNAas DNAgs DNAcs OxyAs OxyGs OxyG DNAts DNAas DNAgs DNAas |
| 1320 | 251036 | 251054 | TTATTATTAATT GAGATTGT | ASO-0079 | OxyTs OxyTs OxyAs OxyTs DNAts DNAas DNAts DNAas DNAas OxyTs OxyTs OxyGs OxyT DNAts DNAas DNAgs DNAas |
| 1321 | 251421 | 251438 | TAATTTATTATT AATTGAG | ASO-1429 | OxyTs OxyAs OxyTs DNAts DNAts OxyTs OxyAs OxyGs OxyAs OxyG DNAts DNAas DNAas DNAts |
| 1322 | 251728 | 251745 | TGTTACTAAAC TTCTTGA | ASO-1430 | OxyTs OxyGs DNAts DNAcs OxyTs OxyTs OxyGs OxyA DNAts DNAts DNAas DNAts DNAts |
| 1323 | 251947 | 251964 | CAGACAATTTG GTTTAC | ASO-1431 | OxyMCs DNAgs DNAts DNAts OxyTs OxyTs OxyAs OxyMC DNAgs DNAas DNAcs DNAas DNAas DNAts DNAgs |
| 1324 | 251947 | 251966 | AAAGGATACTG GAACTTT | ASO-1432 | OxyAs OxyAs OxyGs DNAgs OxyMCs OxyTs OxyTs OxyT DNAgs DNAas DNAas DNAts DNAts DNAas DNAas |
| 1325 | 251948 | 251966 | GAAAAGGATAC TGGAACTTT | ASO-1433 | OxyGs OxyAs OxyAs DNAas OxyMCs OxyTs OxyTs OxyT DNAts DNAgs DNAas DNAts DNAats DNAcs |
| 1326 | 251988 | 252004 | GAAAAGGATAC TGGAACTT | ASO-1434 | OxyGs OxyAs OxyAs DNAas OxyMCs OxyTs OxyTs OxyT DNAts DNAgs DNAas DNAts DNAats DNAas |
| 1327 | 252038 | 252055 | CAGTTGTGTT ATTGGA | ASO-1435 | OxyMCs DNAts DNAts OxyGs OxyGs OxyA DNAas DNAats DNAats DNAats DNAats DNAats DNAas |
| 1328 | 252038 | 252056 | AGCAAATTTAG AACTAAA | ASO-1436 | OxyAs OxyGs OxyMCs DNAas OxyTs OxyAs OxyA DNAgs DNAas DNAcs DNAats DNAts DNAas |
| 1329 | 252039 | 252056 | CAGCAAATTTA GAACTAAA | ASO-1437 | OxyMCs OxyAs OxyGs OxyMCs DNAas DNAas OxyTs OxyAs OxyA DNAgs DNAas DNAcs DNAats DNAas |
| 1330 | 252238 | 252256 | CAGCAAATTTA GAACTAA | ASO-1438 | OxyMCs OxyAs OxyGs OxyMCs DNAas DNAas OxyTs OxyAs OxyA DNAgs DNAas DNAcs DNAats DNAas |
| 1331 | 252239 | 252256 | GCTGCTGTAAA ATGAGAGT | ASO-1439 | OxyGs DNAcs DNAts DNAgs DNAts DNAgs OxyAs OxyGs OxyT DNAas DNAas DNAts DNAts DNAas |
| 1332 | 252280 | 252298 | GCTGCTGTAAA ATGAGAG | ASO-1440 | OxyGs DNAcs DNAts DNAgs DNAts DNAgs OxyAs OxyAs OxyG DNAas DNAas DNAts DNAts DNAas |
| 1333 | 252281 | 252298 | TAACTTACCTTT ACTCCAT | ASO-1441 | OxyTs DNAts DNAas DNAcs DNAts DNAts OxyMCs OxyAs OxyT DNAts DNAats DNAcs DNAts DNAts |
| 1334 | 252281 | 252299 | TAACTTACCTTT ACTCCA | ASO-1442 | OxyTs DNAts DNAas DNAcs DNAts DNAts OxyMCs OxyMCs OxyA DNAts DNAats DNAcs DNAts DNAts |
| | | | TTAACTTACCTT | ASO- | OxyTs OxyTs DNAas DNAts DNAas DNAcs DNAts DNAts DNAats DNAcs DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1335 | 252281 | 252300 | TTTAACTTACCT TACTCCA | ASO-1443 | DNAts DNAts DNAas DNAts DNAcs DNAts DNAcs OxyMCs OxyA |
| 1336 | 252282 | 252300 | TTAACTTACCTT TACTCCA | ASO-1444 | OxyTs OxyTs DNAts DNAas DNAts DNAcs DNAts DNAcs DNAts DNAas DNAts DNAcs OxyMCs OxyA |
| 1337 | 252282 | 252299 | TTAACTTACCTT TACTCC | ASO-1445 | DNAts DNAts DNAas DNAts DNAcs DNAts DNAas DNAts DNAcs DNAts DNAcs OxyMCs OxyMC |
| 1338 | 252283 | 252300 | TTTAACTTACCT TACTCC | ASO-1446 | OxyTs OxyTs OxyTs DNAas DNAts DNAts DNAas DNAts DNAcs DNAts DNAas DNAts DNAcs OxyMCs OxyMC |
| 1339 | 252283 | 252299 | TTAACTTACCTT TACTC | ASO-1447 | OxyTs OxyTs OxyAs DNAas DNAts DNAcs DNAts DNAas DNAts DNAcs DNAts DNAcs OxyMCs OxyMC |
| 1340 | 252284 | 252301 | GTTTAACTTAC CTTTACT | ASO-1448 | DNAts DNAts DNAas DNAts DNAcs OxyMCs OxyMC |
| 1341 | 252285 | 252301 | GTTAACTTAC CTTTACT | ASO-1449 | OxyGs OxyTs OxyTs OxyTs DNAas DNAcs DNAts DNAas DNAts DNAcs OxyMCs OxyT |
| 1342 | 252285 | 252302 | GTTTAACTTAC CTTTAC | ASO-1450 | OxyGs OxyTs OxyTs DNAas DNAts DNAas DNAcs DNAts DNAcs DNAts DNAcs OxyMC |
| 1343 | 252285 | 252303 | TGTTTAACTTAC CTTTAC | ASO-1451 | OxyTs OxyGs OxyTs DNAts DNAts DNAas DNAts OxyTs OxyAs OxyMC |
| 1344 | 252285 | 252304 | CTGTTTAACTTA CCTTTAC | ASO-1452 | OxyMCs DNAts DNAgs DNAcs DNAts DNAts OxyTs OxyAs OxyMC |
| 1345 | 252286 | 252303 | TCTGTTTAACTT ACCTTTAC | ASO-1453 | OxyTs OxyMCs DNAts DNAgs DNAts DNAts DNAts DNAts OxyTs OxyAs OxyMC |
| 1346 | 252286 | 252304 | CTGTTTAACTTA CCTTTA | ASO-1454 | OxyMCs OxyTs DNAgs DNAcs DNAcs OxyTs OxyTs OxyA |
| 1347 | 252286 | 252305 | TCTGTTTAACT ACCTTTA | ASO-1455 | OxyTs OxyAs OxyMCs DNAgs DNAcs DNAts DNAts OxyTs OxyA |
| 1348 | 252287 | 252305 | ATCTGTTTAACT TACCTTTA | ASO-1456 | OxyAs OxyTs OxyMCs DNAts DNAgs DNAts DNAts DNAas DNAts DNAcs DNAts OxyTs OxyT |
| 1349 | 252287 | 252306 | ATCTGTTTAACT TACCTTT | ASO-1457 | OxyMCs OxyAs OxyTs OxyMCs DNAts DNAgs DNAts DNAts DNAas DNAts DNAcs OxyTs OxyT |
| 1350 | 252288 | 252305 | CATCTGTTTAA CTTACCTTT | ASO-1458 | OxyAs OxyTs OxyMCs DNAts DNAcs DNAts DNAas DNAts DNAcs OxyMCs OxyT |
| 1351 | 252288 | 252306 | ATCTGTTTAACT TACCTT | ASO-1459 | OxyMCs OxyAs DNAts DNAcs DNAts DNAas DNAts DNAcs DNAts DNAas DNAts OxyMCs OxyT |
| 1352 | 252289 | 252305 | CATCTGTTTAA CTTACCTT | ASO-1460 | OxyAs DNAts DNAts DNAcs DNAts DNAas OxyMCs OxyMCs OxyT |
| 1353 | 252289 | 252306 | CATCTGTTTAA CTTACCT | ASO-1461 | OxyMCs DNAaas DNAts DNAcs DNAts DNAgs DNAts OxyMCs OxyT |
| | 252290 | 252306 | CATCTGTTTAA CTTACCT | ASO- | OxyMCs OxyAs OxyTs OxyMCs DNAts DNAcs DNAts DNAgs DNAts OxyAs OxyMCs OxyMCs DNAts DNAts DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1354 | 252290 | 252307 | GCATCTGTTTA ACTTACC | ASO-1462 | DNAas DNAcs DNAts DNAts OxyAs OxyMCs OxyMC |
| 1355 | 252336 | 252355 | TAACATTTAAA GATTATCCA | ASO-1463 | OxyGs DNAcs DNAas DNAts DNAgs DNAts DNAts DNAaas DNAas DNAts DNAts OxyAs OxyMCs OxyMC |
| 1356 | 252624 | 252643 | TTATTTGGAAA AGCATTTGG | ASO-1464 | OxyTs OxyAs OxyAs DNAas DNAts DNAts DNAas DNAts DNAas DNAas OxyTs OxyMCs OxyA |
| 1357 | 252879 | 252897 | TATTATTTTGTT TAGAAAG | ASO-1465 | OxyTs DNAts DNAas DNAts DNAts DNAts DNAgs DNAas DNAas OxyTs OxyGs OxyG |
| 1358 | 253054 | 253071 | GTGTTGATGAA GAATGTA | ASO-1466 | OxyTs OxyAs OxyTs OxyTs DNAas DNAts DNAas DNAgs OxyAs OxyAs OxyG |
| 1359 | 253080 | 253097 | ATTAATTAATTC CCAAGA | ASO-1467 | OxyGs OxyTs OxyGs DNAts DNAgs DNAts DNAgs DNAts DNAas DNAts DNAts OxyTs OxyA |
| 1360 | 253537 | 253553 | TATAAGTTGAA TGGAAG | ASO-1468 | OxyAs OxyTs OxyTs DNAas DNAts DNAts DNAas DNAas OxyGs OxyA |
| 1361 | 253645 | 253661 | TTCTGAATTGA CCAGTC | ASO-1469 | OxyTs OxyAs OxyTs OxyGs OxyGs OxyAs OxyG |
| 1362 | 253645 | 253662 | TTTCTGAATTG ACCAGTC | ASO-1470 | OxyTs OxyTs OxyMCs DNAts DNAgs DNAas DNAts DNAts DNAts DNAgs OxyTs OxyMC |
| 1363 | 253647 | 253664 | CTTTTCTGAATT GACCAG | ASO-1471 | OxyTs OxyTs OxyTs OxyMCs DNAts DNAgs DNAas DNAts DNAts DNAgs OxyTs OxyMC |
| 1364 | 253648 | 253665 | CCTTTTCTGAA TTGACCA | ASO-1472 | OxyMCs DNAts DNAgs DNAas DNAts DNAts DNAts DNAgs DNAas DNAts DNAts DNAgs OxyTs OxyMC |
| 1365 | 253649 | 253666 | TCCTTTTCTGA ATTGACC | ASO-1473 | OxyMCs DNAcs DNAcs DNAts DNAgs DNAas DNAts DNAts DNAts DNAgs DNAas OxyMCs OxyA |
| 1366 | 253649 | 253667 | TTCCTTTTCTGA ATTGACC | ASO-1474 | OxyTs OxyMCs DNAcs DNAcs DNAts DNAgs DNAas DNAts DNAts DNAts DNAgs OxyMCs OxyMC |
| 1367 | 253673 | 253689 | CATCTGAACAC TCGAAC | ASO-1475 | OxyTs OxyTs OxyMCs DNAcs DNAts DNAts DNAgs DNAas DNAts DNAts DNAgs OxyMCs OxyMC |
| 1368 | 253673 | 253690 | TCATCTGAACA CTCGAAC | ASO-1476 | OxyMCs OxyAs OxyTs OxyMCs DNAts DNAcs DNAts DNAgs DNAas OxyAs OxyMC |
| 1369 | 253673 | 253691 | ATCATCTGAAC ACTCGAAC | ASO-1477 | OxyTs OxyMCs OxyAs DNAts DNAcs DNAts DNAgs DNAas DNAmcs DNAas OxyAs OxyMC |
| 1370 | 253673 | 253692 | CATCATCTGAA CACTCGAAC | ASO-1478 | OxyAs OxyTs OxyMCs OxyAs DNAts DNAcs DNAts DNAgs DNAas DNAmcs DNAas DNAcs OxyAs OxyMC |
| 1371 | 253676 | 253691 | ATCATCTGAAC ACTCG | ASO-1479 | OxyMCs OxyMCs OxyAs DNAts DNAcs DNAts DNAgs DNAas OxyAs OxyMC |
| 1372 | 253676 | 253692 | CATCATCTGAA | ASO-1480 | OxyAs OxyTs OxyMCs OxyAs DNAts DNAcs DNAts OxyTs OxyMCs OxyG |
| 1372 | 253676 | 253692 | CATCATCTGAA | ASO- | OxyMCs OxyAs DNAts DNAcs DNAts DNAcs DNAts DNAgs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1373 | 253861 | 253879 | CAAATTCAATTT CACTCG | ASO-1481 | DNAas DNAcs DNAas DNAcs OxyTs OxyMCs OxyG |
| 1374 | 254164 | 254183 | AGGTGTTAAAT CAGAGAA | ASO-1482 | OxyMCs OxyAs OxyAs DNAts OxyAs DNAts DNAcs DNAas DNAts DNAts DNAts DNAcs DNAas DNAgs OxyAs OxyAs OxyA |
| 1375 | 254301 | 254319 | GTGTGATATAA TTATTTA | ASO-1483 | OxyAs OxyGs OxyGs DNAts DNAgs DNAts DNAts OxyGs OxyTs OxyTs OxyT |
| 1376 | 254884 | 254903 | TTAAATGAATAT GTGCCTCA | ASO-1484 | OxyGs OxyTs OxyGs OxyTs DNAgs DNAas DNAts OxyTs OxyTs OxyA |
| 1377 | 254916 | 254933 | TTCTTTATTGTT AGGTAT | ASO-1485 | OxyTs OxyTs OxyAs OxyAs DNAas DNAts DNAgs DNAas DNAcs DNAcs OxyTs OxyMCs OxyA |
| 1378 | 255212 | 255231 | TATTTAATATGC TATATTA | ASO-1486 | OxyTs OxyTs OxyMCs OxyMCs DNAts DNAts DNAts DNAas DNAts DNAgs DNAts OxyGs OxyAs OxyT |
| 1379 | 255431 | 255448 | AGAATTTAACA TGATATT | ASO-1487 | OxyTs OxyAs OxyAs OxyTs DNAts DNAas OxyTs OxyTs OxyTs OxyA |
| 1380 | 255686 | 255703 | TAGTATTGAGA GGAAGAT | ASO-1488 | OxyAs OxyGs OxyAs OxyAs DNAts DNAts DNAgs DNAas DNAcs DNAas OxyTs OxyAs OxyT |
| 1381 | 255869 | 255888 | TATTTTATTATTT TCTAAAGG | ASO-1808 | OxyTs OxyAs OxyGs OxyTs DNAts DNAas DNAgs DNAas DNAas OxyAs OxyAs OxyT |
| 1382 | 256137 | 256155 | TAAAGAATATAT CATTACC | ASO-1489 | OxyTs OxyAs OxyGs OxyTs DNAts DNAcs DNAas DNAas OxyAs OxyAs OxyGs OxyG |
| 1383 | 256310 | 256326 | TTCAATTATTAG TGGGG | ASO-1490 | OxyTs OxyAs OxyAs OxyAs DNAgs DNAas DNAts DNAas DNAts DNAas OxyAs OxyMC |
| 1384 | 256760 | 256778 | GATGAACGTGA AGACATG | ASO-1491 | OxyTs OxyTs OxyMCs DNAgs DNAts DNAas DNAts DNAas DNAts DNAas DNAts DNAas |
| 1385 | 256864 | 256883 | TGCAGAAAATA GAAACAGAG | ASO-1492 | OxyGs OxyGs OxyTs OxyGs DNAas DNAas DNAgs DNAas DNAmcs OxyAs OxyTs OxyG |
| 1386 | 256865 | 256884 | ATGCAGAAAAT AGAAACAGA | ASO-1493 | OxyTs OxyGs OxyMCs DNAas DNAas DNAgs DNAas DNAas DNAas OxyAs OxyAs OxyGs OxyG |
| 1387 | 256887 | 256904 | TTTGTTGTTTAT CTGTGG | ASO-1494 | OxyAs OxyTs OxyGs OxyMCs DNAas DNAgs DNAts DNAts OxyAs OxyGs OxyGs OxyA |
| 1388 | 256887 | 256905 | CTTTGTTGTTTA TCTGTGG | ASO-1495 | OxyTs DNAts DNAts DNAts DNAcs DNAts DNAgs DNAts OxyGs OxyGs OxyG |
| 1389 | 256888 | 256905 | CTTTGTTGTTTA TCTGTG | ASO-1496 | OxyMCs OxyTs DNAts DNAcs DNAts DNAts DNAgs DNAts OxyGs OxyG |
| 1390 | 256889 | 256906 | GCTTTGTTGTT TATCTGT | ASO-1497 | OxyMCs DNAts DNAcs DNAts DNAts DNAts DNAts DNAgs DNAts OxyGs OxyTs OxyG |
| 1391 | 256890 | 256908 | TGGCTTTGTTG | ASO-1498 | OxyGs OxyMCs DNAts DNAts DNAts DNAgs DNAts DNAts DNAgs DNAts OxyGs OxyT |
| | | | | ASO- | OxyTs DNAgs DNAgs DNAcs DNAts DNAts DNAts DNAgs DNAts DNAts DNAgs DNAts DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1392 | | | TTTATCTG | 1499 | DNAts DNAts DNAts DNAgs DNAas DNAcs DNAts DNAcs OxyTs OxyG |
| 1393 | 256891 | 256909 | TTGGCTTTGTT GTTTATCT | ASO-1500 | OxyTs DNAts DNAgs DNAgs DNAcs DNAts DNAts DNAgs DNAts DNAts DNAgs DNAts DNAts DNAts DNAts DNAas DNAts OxyMCs OxyT |
| 1394 | 256892 | 256908 | TGGCTTTGTTG TTTATC | ASO-1501 | OxyTs OxyGs OxyGs DNAts DNAas DNAts DNAts DNAgs DNAts DNAts DNAgs DNAts DNAts DNAas OxyTs OxyMC |
| 1395 | 256892 | 256909 | TTGGCTTTGTT GTTTATC | ASO-1502 | OxyTs OxyTs OxyGs DNAgs DNAcs DNAts DNAts DNAts DNAts DNAgs DNAts DNAts DNAas OxyTs OxyMC |
| 1396 | 256893 | 256910 | GTTGGCTTTGT TGTTTAT | ASO-1503 | DNAgs DNAts DNAts DNAgs DNAgs DNAcs DNAts DNAts DNAts DNAgs DNAts DNAts DNAts DNAts OxyTs OxyTs OxyAs OxyT |
| 1397 | 256893 | 256911 | CGTTGGCTTTG TTGTTTAT | ASO-1504 | OxyMCs DNAgs DNAts DNAts DNAgs DNAgs DNAcs DNAts DNAts DNAts DNAgs DNAts DNAts DNAts DNAts OxyTs OxyAs OxyT |
| 1398 | 256893 | 256912 | ACGTTGGCTTT GTTGTTTAT | ASO-1505 | OxyAs DNAmcs DNAgs DNAts DNAts DNAgs DNAgs DNAcs DNAts DNAts DNAts DNAgs DNAts DNAts OxyTs OxyAs OxyT |
| 1399 | 256894 | 256911 | CGTTGGCTTTG TTGTTA | ASO-1506 | OxyMCs DNAgs DNAts DNAts DNAgs DNAgs DNAts DNAts DNAts DNAgs DNAts DNAts DNAts DNAts OxyTs OxyA |
| 1400 | 256894 | 256912 | ACGTTGGCTTT GTTGTTTA | ASO-1507 | OxyAs DNAmcs DNAgs DNAts DNAts DNAgs DNAgs DNAts DNAts DNAts DNAgs DNAts DNAts DNAts DNAts OxyTs OxyA |
| 1401 | 256918 | 256935 | TATTTTCTTTGG GGCTGG | ASO-1508 | OxyTs OxyAs DNAts DNAts DNAts DNAts DNAcs DNAts DNAts DNAts DNAts DNAts DNAts OxyGs OxyG |
| 1402 | 256919 | 256936 | ATATTTTCTTTG GGCTG | ASO-1509 | OxyAs OxyTs OxyAs DNAts DNAts DNAts DNAts DNAts DNAcs DNAts DNAts DNAts OxyTs OxyG |
| 1403 | 256920 | 256936 | ATATTTTCTTTG GGGCT | ASO-1510 | OxyAs DNAts DNAts DNAts DNAts DNAts DNAts DNAts DNAcs DNAts DNAts DNAts OxyTs OxyG |
| 1404 | 256920 | 256937 | AATATTTCTTT GGGCT | ASO-1511 | DNAgs DNAgs OxyGs OxyAs OxyTs OxyAs DNAts DNAts DNAts DNAts DNAgs OxyMCs OxyT |
| 1405 | 256923 | 256940 | AGGAATATTTT CTTTGGG | ASO-1512 | OxyAs OxyGs OxyGs DNAas DNAas DNAts DNAts DNAts DNAts DNAts DNAts DNAts OxyT |
| 1406 | 256975 | 256992 | GTAAAGAACTT AAGAAGG | ASO-1513 | DNAcs DNAts DNAts DNAts DNAts DNAts DNAgs OxyGs OxyG |
| 1407 | 257413 | 257432 | GTGTTTAATAA GAGGGAAA | ASO-1514 | OxyGs OxyTs OxyAs DNAas DNAas DNAgs OxyAs OxyAs DNAas DNAas DNAas DNAgs OxyGs OxyAs OxyG |
| 1408 | 257603 | 257620 | ATTGTGTGGAT TGATTG | ASO-1515 | OxyAs OxyTs OxyTs DNAts DNAas DNAgs DNAgs DNAas DNAas DNAas DNAas DNAts DNAts DNAts OxyTs OxyG |
| 1409 | 257607 | 257624 | GTTAATTGTGT GGATTTG | ASO-1516 | OxyGs OxyTs DNAts DNAts DNAas DNAts DNAas DNAts DNAts DNAts DNAts DNAts DNAts OxyTs OxyTs OxyG |
| 1410 | 258296 | 258315 | TAATCACTATAA TTTGAGGC | ASO-1517 | OxyTs OxyAs OxyAs DNAts DNAts DNAts DNAgs DNAts DNAts DNAas OxyGs OxyGs OxyMC |
| | 258509 | 258526 | GTTATATTGGT | ASO- | OxyGs OxyTs OxyAs DNAts DNAts DNAas DNAas DNAts DNAts DNAts DNAts DNAts DNAgs DNAts DNAgs DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1411 | 258713 | 258730 | TTGAAAC | ASO-1518 | DNAts DNAts DNAgs OxyAs OxyAs OxyAs OxyMC |
| 1412 | 258713 | 258730 | AAAAGACCTTA TTCTTGA | ASO-1519 | OxyAs OxyAs OxyAs DNAgs DNAas DNAcs DNAts DNAts DNAas DNAts DNAts DNAcs OxyTs OxyGs OxyA |
| 1413 | 258713 | 258731 | CAAAAGACCTT ATTCTTGA | ASO-1520 | OxyMCs OxyAs OxyAs OxyAs DNAgs DNAas DNAcs DNAts DNAts DNAas DNAts DNAts DNAcs OxyTs OxyTs OxyGs OxyA |
| 1414 | 258713 | 258732 | GCAAAAGACCT TATTCTTGA | ASO-1521 | OxyGs DNAcs DNAas DNAts DNAts DNAas DNAgs DNAas DNAcs DNAcs DNAts DNAts DNAcs OxyTs OxyTs OxyGs OxyA |
| 1415 | 258714 | 258731 | CAAAAGACCTT ATTCTTG | ASO-1522 | DNAts DNAts DNAas DNAts DNAts DNAcs OxyMCs OxyTs OxyTs OxyG |
| 1416 | 258714 | 258732 | GCAAAAGACCT TATTCTTG | ASO-1523 | OxyGs OxyMCs OxyAs OxyAs DNAas DNAgs DNAas DNAas DNAcs DNAcs DNAts DNAts DNAcs DNAts DNAts OxyTs OxyG |
| 1417 | 258714 | 258733 | TGCAAAAGACC TTATTCTTG | ASO-1524 | OxyTs OxyGs DNAcs DNAas DNAts DNAts DNAas DNAgs DNAas DNAas DNAcs DNAcs DNAts DNAts OxyTs OxyTs OxyG |
| 1418 | 258715 | 258732 | GCAAAAGACCT TATTCTT | ASO-1525 | OxyGs OxyMCs OxyAs DNAas DNAts DNAts DNAas DNAgs DNAas DNAas DNAcs DNAcs OxyTs OxyMCs OxyTs OxyT |
| 1419 | 258715 | 258733 | TGCAAAAGACC TTATTCTT | ASO-1526 | OxyTs OxyGs DNAcs DNAas DNAts DNAts DNAas DNAgs DNAas DNAas DNAcs DNAts DNAcs OxyMCs OxyTs OxyT |
| 1420 | 258715 | 258734 | ATGCAAAAGAC CTTATTCTT | ASO-1527 | OxyAs OxyTs OxyGs DNAcs DNAas DNAts DNAts DNAas DNAgs DNAas DNAts DNAcs DNAcs OxyMCs OxyTs OxyT |
| 1421 | 258716 | 258732 | GCAAAAGACCT TATTCT | ASO-1528 | OxyGs OxyMCs OxyAs OxyAs DNAas DNAgs DNAas DNAas DNAcs DNAcs DNAts DNAts DNAts OxyTs OxyMCs OxyT |
| 1422 | 258716 | 258733 | TGCAAAAGACC TTATTCT | ASO-1529 | OxyTs OxyGs OxyMCs DNAas DNAts DNAts DNAas DNAgs DNAas DNAas DNAcs DNAts DNAts OxyMCs OxyT |
| 1423 | 258717 | 258734 | ATGCAAAAGAC CTTATTC | ASO-1530 | OxyAs OxyTs OxyGs OxyMCs DNAas DNAts DNAts DNAas DNAgs DNAas DNAas DNAcs DNAts OxyTs OxyTs OxyMC |
| 1424 | 258838 | 258856 | ATGAAATAGTG ACAAGAC | ASO-1531 | OxyAs OxyTs OxyGs OxyAs DNAas DNAts DNAas DNAgs DNAts DNAgs DNAas DNAcs DNAas DNAgs OxyAs OxyGs OxyMC |
| 1425 | 258953 | 258969 | TTACAGTAGTT TGGGGC | ASO-1532 | OxyTs OxyTs DNAas DNAcs DNAas DNAgs DNAts DNAas DNAgs DNAts DNAts OxyGs OxyGs OxyMC |
| 1426 | 258953 | 258970 | ATTACAGTAGT TTGGGGC | ASO-1533 | OxyAs OxyTs DNAts DNAas DNAcs DNAas DNAgs DNAts DNAas DNAgs DNAts DNAts DNAts OxyGs OxyGs OxyMC |
| 1427 | 258954 | 258970 | ATTACAGTAGT TTGGGG | ASO-1534 | OxyAs OxyTs DNAts OxyTs DNAas DNAcs DNAas DNAgs DNAts DNAas DNAgs DNAts DNAts OxyGs OxyGs OxyG |
| 1428 | 258965 | 258981 | CAGGGTTGTGG ATTACA | ASO-1535 | OxyMCs OxyAs DNAgs DNAas DNAts DNAts DNAas DNAgs DNAts DNAts DNAts OxyMCs OxyA |
| 1429 | 258965 | 258982 | TCAGGGTTGTG GATTACA | ASO-1536 | OxyTs OxyMCs DNAgs DNAgs DNAgs DNAts DNAts DNAgs DNAts DNAgs DNAts DNAts DNAts OxyAs OxyMCs OxyA |
| 1430 | 258966 | 258982 | TCAGGGTTGTG GATTACA | ASO- | OxyTs OxyMCs DNAgs DNAas DNAts DNAas DNAgs DNAts DNAts DNAts OxyGs OxyAs OxyT |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1430 | 258967 | 258982 | GATTAC | 1537 | DNAgs DNAgs DNAas OxyTs OxyTs OxyAs OxyMC |
| 1431 | 258984 | 259001 | TCAGGGTTGTG GATTA | ASO-1538 | OxyTs OxyMCs DNAas DNAgs DNAgs DNAts DNAts DNAgs DNAts DNAgs DNAgs OxyAs OxyTs OxyTs OxyA |
| 1432 | 259095 | 259111 | TCTGAATACCT TGTTCC | ASO-1539 | OxyTs OxyMCs DNAts DNAgs DNAas DNAts DNAas DNAcs DNAts DNAts DNAts DNAts OxyMCs OxyMC |
| 1433 | 259409 | 259426 | GTGGTAGAAAA TGGTTA | ASO-1540 | OxyGs OxyTs OxyGs DNAgs DNAts DNAas DNAgs DNAas DNAas DNAas OxyTs OxyA |
| 1434 | 259752 | 259769 | ACTCAAAAGTA ACACTAA | ASO-1541 | DNAas DNAts DNAgs OxyGs OxyTs OxyTs OxyA DNAas OxyAs OxyTs OxyMCs DNAas DNAas DNAas DNAgs DNAts OxyAs OxyA |
| 1435 | 260259 | 260275 | AATTGGACACA TGGAATA | ASO-1542 | OxyAs OxyAs OxyTs OxyTs DNAgs DNAgs DNAas DNAcs DNAas DNAcs DNAas DNAts DNAgs DNAgs OxyAs OxyAs OxyTs OxyA |
| 1436 | 260398 | 260417 | TTAATGTGACC TAGTAT | ASO-1543 | OxyTs OxyTs OxyAs DNAts DNAas DNAgs DNAts DNAts DNAas DNAgs DNAcs DNAas OxyGs OxyTs OxyAs OxyT |
| 1437 | 260451 | 260468 | ATTTTAGAGATT CAGTATTC | ASO-0080 | OxyAs OxyTs OxyTs OxyTs DNAts DNAas DNAgs DNAas OxyAs OxyTs OxyTs OxyMC |
| 1438 | 260810 | 260828 | TCAGTAATGGA AACAGA | ASO-1544 | OxyTs OxyMCs OxyAs OxyGs DNAts DNAas DNAts DNAgs DNAgs OxyGs OxyA |
| 1439 | 261157 | 261173 | TGGAATTATAA TGAATAAT | ASO-1545 | OxyTs OxyGs OxyGs DNAas DNAas DNAts DNAts DNAas DNAts OxyAs OxyAs OxyT |
| 1440 | 261162 | 261179 | TGTAGAAGCAG CGGAAG | ASO-1546 | OxyTs DNAgs DNAts DNAgs DNAmcs DNAgs OxyGs OxyAs OxyG |
| 1441 | 261398 | 261417 | GTGATTTGTAG AAGCAGC | ASO-1547 | OxyGs OxyTs DNAgs DNAgs DNAcs DNAts DNAts OxyAs OxyGs OxyMC |
| 1442 | 261399 | 261417 | CCTGATGAGAA GAAAACACA | ASO-1548 | OxyMCs OxyMCs DNAts DNAgs DNAas DNAas OxyMCs OxyAs OxyMCs OxyA |
| 1443 | 261399 | 261417 | CCTGATGAGAA GAAAACAC | ASO-1549 | OxyMCs OxyMCs DNAts DNAgs DNAas DNAas OxyMCs OxyAs OxyMCs OxyT |
| 1444 | 261400 | 261418 | TCCTGATGAGA AGAAAACAC | ASO-1550 | OxyTs OxyMCs OxyMCs OxyTs DNAgs DNAas DNAts DNAgs OxyMCs OxyAs OxyMC |
| 1445 | 261400 | 261417 | CCTGATGAGAA GAAAACA | ASO-1551 | OxyMCs OxyMCs OxyTs OxyGs DNAas DNAgs DNAas OxyAs OxyAs OxyMCs OxyA |
| 1446 | 261401 | 261418 | TCCTGATGAGA AGAAAACA | ASO-1552 | OxyTs OxyMCs OxyMCs OxyTs DNAgs DNAas OxyAs OxyMCs OxyA |
| 1447 | 261451 | 261469 | TCCTGATGAGA AGAAAC | ASO-1553 | OxyTs OxyMCs OxyMCs OxyTs DNAgs DNAas OxyAs OxyMCs OxyMC |
| 1448 | 261451 | 261470 | ATACCTTTCAC ATCTTCAT | ASO-1554 | OxyAs DNAts DNAas DNAts DNAts DNAts OxyTs OxyMCs OxyAs OxyT |
| | | | CATACCTTTCA | ASO- | OxyMCs OxyAs DNAts DNAas DNAcs DNAts DNAcs DNAts DNAts DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1449 | 261452 | 261469 | CATCTTCAT | 1555 | DNAas DNAcs DNAts DNAas DNAts DNAcs DNAts DNAts DNAcs OxyAs OxyT |
| 1450 | 261452 | 261469 | ATACCTTTCAC ATCTTCA | 1556 | OxyAs DNAts DNAas DNAcs DNAts DNAts DNAts DNAcs DNAas DNAcs DNAts DNAas DNAcs OxyTs OxyMCs OxyA |
| 1451 | 261453 | 261470 | CATACCTTTCA CATCTTCA | 1557 | OxyMCs OxyAs DNAas DNAcs DNAts DNAas DNAcs DNAts DNAts DNAcs DNAts DNAts OxyMCs OxyA |
| 1452 | 261453 | 261470 | ATACCTTTCAC ATCTTC | 1558 | OxyAs DNAts DNAas DNAcs DNAas DNAcs DNAts DNAts DNAcs DNAas DNAcs DNAts DNAcs OxyTs OxyMC |
| 1453 | 261453 | 261469 | CATACCTTTCA CATCTTC | 1559 | OxyMCs OxyAs DNAts DNAas DNAcs DNAas DNAcs DNAts DNAts DNAcs DNAts OxyMCs OxyTs OxyMC |
| 1454 | 261453 | 261471 | TCATACCTTTC ACATCTTC | 1560 | OxyTs OxyMCs OxyAs DNAts DNAas DNAcs DNAas DNAcs DNAts DNAts DNAcs DNAts OxyTs OxyMC |
| 1455 | 261453 | 261472 | ATCATACCTTT CACATCTTC | 1561 | OxyAs DNAts DNAcs DNAas DNAcs DNAas DNAcs DNAts DNAts DNAcs OxyMCs OxyTs OxyMC |
| 1456 | 261454 | 261471 | TCATACCTTTC ACATCTT | 1562 | OxyTs OxyMCs OxyAs DNAts DNAas DNAcs DNAas DNAcs DNAts DNAcs OxyMCs OxyTs OxyT |
| 1457 | 261454 | 261472 | ATCATACCTTT CACATCTT | 1563 | OxyAs OxyTs OxyMCs OxyAs DNAts DNAas DNAcs DNAas DNAcs DNAts DNAts OxyTs OxyT |
| 1458 | 261454 | 261473 | AATCATACCTTT CACATCTT | 1564 | OxyAs OxyAs DNAts DNAts DNAcs DNAas DNAcs DNAas DNAcs DNAts OxyTs OxyT |
| 1459 | 261455 | 261472 | ATCATACCTTT CACATCT | 1565 | OxyAs OxyTs OxyMCs OxyAs DNAts DNAas DNAcs DNAas DNAcs DNAts OxyMCs OxyT |
| 1460 | 261455 | 261473 | AATCATACCTTT CACATCT | 1566 | OxyAs OxyAs OxyTs OxyMCs DNAas DNAcs DNAas DNAcs DNAts OxyMCs OxyT |
| 1461 | 261455 | 261474 | AAATCATACCT TTCACATCT | 1567 | OxyAs OxyAs OxyAs DNAts DNAas DNAcs DNAas DNAcs OxyAs OxyTs OxyMCs OxyT |
| 1462 | 261456 | 261472 | ATCATACCTTT CACATC | 1568 | OxyAs OxyTs OxyMCs OxyAs DNAts DNAas DNAcs DNAas DNAcs OxyAs OxyTs OxyMC |
| 1463 | 261456 | 261473 | AATCATACCTTT CACATC | 1569 | OxyAs OxyAs OxyTs OxyMCs OxyAs DNAts DNAas DNAas DNAcs OxyAs OxyTs OxyMC |
| 1464 | 261456 | 261474 | AAATCATACCT TTCACATC | 1570 | OxyAs OxyAs OxyAs OxyTs DNAcs DNAts DNAas DNAas OxyMCs OxyAs OxyTs OxyMC |
| 1465 | 261456 | 261475 | TAAATCATACC TTTCACATC | 1571 | OxyTs OxyAs OxyAs OxyAs DNAts DNAcs DNAts DNAas OxyMCs OxyAs OxyTs OxyMC |
| 1466 | 261457 | 261475 | TAAATCATACC TTTCACAT | 1572 | OxyTs OxyAs OxyAs OxyAs DNAts DNAcs DNAts DNAas OxyMCs OxyAs OxyAs OxyT |
| 1467 | 261457 | 261476 | TTAAATCATAC CTTTCACAT | 1573 | OxyTs OxyTs OxyAs OxyAs OxyAs DNAts DNAts DNAas DNAts DNAcs OxyAs OxyAs OxyT |
| | 261458 | 261475 | TAAATCATACC | | OxyTs OxyAs OxyAs OxyAs DNAts DNAcs DNAts DNAas DNAts DNAcs DNAas DNAcs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1468 | 261458 | 261476 | TTTCACA | 1574 | DNAts DNAts DNAt OxyMCs OxyAs OxyMCs OxyA |
| 1469 | 261458 | 261476 | TTAAATCATAC CTTTCACA | 1575 | OxyTs OxyTs OxyAs OxyAs DNAas DNAts DNAcs DNAas DNAts DNAcs DNAts DNAts DNAt OxyMCs OxyAs OxyMCs OxyA |
| 1470 | 261459 | 261477 | GTTAAATCATA CCTTTCACA | 1576 | OxyGs OxyTs OxyTs DNAas DNAas DNAts DNAts DNAcs DNAas DNAts DNAcs OxyAs OxyMCs OxyA |
| 1471 | 261459 | 261475 | TAAATCATACC TTTCAC | 1577 | OxyTs OxyAs OxyAs OxyAs DNAts DNAts DNAcs DNAas DNAts DNAcs DNAts DNAts OxyTs OxyMCs OxyAs OxyMC |
| 1472 | 261459 | 261476 | TTAAATCATAC CTTTCAC | 1578 | OxyTs OxyTs OxyAs OxyAs DNAts DNAts OxyTs OxyMCs OxyAs OxyMC |
| 1473 | 261459 | 261477 | GTTAAATCATA CCTTTCAC | 1579 | OxyGs OxyTs OxyTs DNAas DNAts DNAts OxyTs OxyMCs OxyAs OxyMC |
| 1474 | 261460 | 261477 | GTTAAATCATA CCTTTCA | 1580 | OxyGs OxyTs OxyTs OxyAs DNAas DNAts DNAts OxyTs OxyTs OxyMCs OxyA |
| 1475 | 261461 | 261477 | GTTAAATCATA CCTTTC | 1581 | OxyGs OxyTs OxyTs OxyAs DNAas DNAts DNAcs DNAts DNAts OxyTs OxyTs OxyMC |
| 1476 | 261720 | 261737 | TCATTATTAGTT GTCATT | 1582 | OxyTs OxyMCs OxyAs OxyTs DNAts DNAas DNAts DNAts DNAas DNAts OxyTs OxyT |
| 1477 | 261878 | 261894 | TTGAGATGACT AAAAGT | 1583 | OxyTs OxyTs OxyGs OxyAs DNAgs DNAts DNAas OxyAs OxyAs OxyGs OxyT |
| 1478 | 262307 | 262323 | CAGATGAGGTT TAATTA | 1584 | OxyMCs OxyAs OxyGs OxyAs DNAts DNAgs DNAas OxyTs OxyTs OxyA |
| 1479 | 262642 | 262661 | AATAAAATTCTT GACACAGC | 1585 | OxyAs OxyAs OxyTs DNAts DNAas DNAcs DNAas DNAts DNAas DNAts OxyGs OxyMC |
| 1480 | 262932 | 262951 | TATTTAAAGATT CAGTTTCT | 1586 | OxyTs OxyAs OxyGs OxyAs DNAts DNAgs DNAts OxyTs OxyTs OxyMCs OxyT |
| 1481 | 263205 | 263221 | TGAATTGGAGA ACTGTT | 1587 | OxyTs OxyGs OxyAs OxyAs DNAts DNAts DNAas DNAts DNAts OxyGs OxyTs OxyT |
| 1482 | 263524 | 263541 | TCAATATTAAAA GGGTTA | 1588 | OxyTs OxyMCs OxyAs OxyAs DNAts DNAts DNAas DNAts OxyTs OxyTs OxyA |
| 1483 | 263847 | 263863 | CTTGGATGTTA GTTATA | 1589 | OxyMCs OxyTs DNAgs DNAgs DNAts OxyAs OxyTs OxyA |
| 1484 | 264041 | 264058 | TGCAGAAGTAT GTATGGG | 1590 | OxyTs OxyGs DNAgs DNAts DNAts DNAts OxyGs OxyGs OxyG |
| 1485 | 264416 | 264435 | ATCTCTGACTA CTTTTGCTT | 1591 | OxyAs DNAts DNAts DNAts OxyMCs DNAas DNAts DNAcs DNAas DNAts OxyTs OxyT |
| 1486 | 264689 | 264705 | ATTCATATAAA GGGTAG | 1592 | OxyAs DNAas DNAts DNAts DNAts DNAgs DNAts OxyGs OxyTs OxyAs OxyG |
| 1487 | 264691 | 264709 | CAAGATTCATA | | OxyMCs OxyAs OxyAs DNAgs DNAts DNAcs DNAts OxyAs OxyG |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1487 | 264912 | 264928 | TAAAGGGT | ASO-0081 | DNAas DNAts DNAas DNAas OxyAs OxyGs OxyGs OxyT |
| 1488 | 266049 | 266067 | AAAATGTGGTT AGAGCT | ASO-1593 | OxyAs OxyAs OxyAs OxyAs DNAts DNAgs DNAts DNAgs DNAts DNAgs DNAts DNAgs OxyAs OxyGs OxyMCs OxyT |
| 1489 | 266049 | 266066 | AGTGAGATACT GGAAACAG | ASO-0082 | OxyGs OxyTs OxyGs DNAas DNAgs DNAts DNAas DNAts DNAgs DNAts DNAgs DNAts DNAgs DNAts DNAgs DNAts DNAgs DNAts DNAgs OxyG |
| 1490 | 266049 | 266066 | GTGAGATACTG GAAACAG | ASO-1594 | OxyAs OxyGs OxyTs DNAgs DNAas DNAgs DNAts DNAgs DNAts DNAas DNAas OxyMCs OxyAs OxyG |
| 1491 | 266057 | 266074 | GAGCTGAAGTG AGATACT | ASO-1595 | OxyGs OxyAs OxyGs DNAcs DNAts DNAgs DNAas DNAas DNAts DNAas OxyMCs OxyT |
| 1492 | 272888 | 272905 | ATGAAACTGTG TTACATT | ASO-1596 | OxyAs OxyTs OxyGs OxyAs DNAas DNAas DNAts DNAcs DNAts DNAgs DNAts DNAgs OxyAs OxyT |
| 1493 | 272889 | 272906 | AATGAAACTGT GTTACAT | ASO-1597 | OxyAs OxyAs OxyTs DNAas DNAts DNAas DNAas OxyMCs OxyAs OxyT |
| 1494 | 273186 | 273203 | AAGAAAAGCTA TTTATAG | ASO-1598 | OxyAs OxyAs OxyGs OxyAs DNAas OxyTs OxyAs OxyG |
| 1495 | 273436 | 273452 | CGATAATGGAA CAGTAG | ASO-1599 | OxyMCs OxyGs DNAas DNAts DNAgs DNAts DNAgs DNAas DNAas OxyTs OxyAs OxyG |
| 1496 | 273657 | 273676 | ATAAAGTAAATT ATATTTGG | ASO-1600 | OxyAs OxyTs OxyAs OxyAs DNAas DNAts DNAas DNAts OxyTs OxyTs OxyGs OxyG |
| 1497 | 273952 | 273970 | CTGCTGTTATG AGGAAACC | ASO-1601 | OxyMCs DNAts DNAgs DNAcs DNAts DNAgs DNAts DNAas OxyAs OxyMCs OxyMC |
| 1498 | 274086 | 274104 | GTTTTATAATAA TATGTAT | ASO-1601 | OxyGs OxyTs OxyTs DNAts DNAas DNAas OxyGs DNAts OxyAs OxyT |
| 1499 | 274365 | 274384 | AATATTAATTTA ATTTTAGA | ASO-1602 | OxyAs OxyAs OxyTs OxyAs DNAts DNAts DNAts OxyTs OxyAs OxyGs OxyA |
| 1500 | 274705 | 274724 | TATTAAAATTGC ACAGGATT | ASO-1603 | OxyTs OxyAs OxyTs DNAts DNAas DNAas DNAgs OxyAs OxyAs OxyTs OxyT |
| 1501 | 274973 | 274992 | TCATCTTTCTTT TCTAAATC | ASO-1604 | OxyTs OxyMCs DNAts DNAas DNAts DNAgs DNAts DNAcs DNAts DNAts OxyAs OxyMC |
| 1502 | 275483 | 275502 | ATTATAATCTTT TCTTACCT | ASO-1605 | OxyAs OxyTs OxyTs DNAts DNAas DNAts DNAts DNAts DNAas OxyMCs OxyT |
| 1503 | 275484 | 275502 | ATTATAATCTTT TCTTACC | ASO-1606 | OxyAs OxyTs DNAts DNAas DNAts DNAts DNAts DNAas OxyMCs OxyMC |
| 1504 | 275895 | 275912 | CATTGGTGAAG AGATATG | ASO-1607 | OxyMCs OxyAs OxyTs DNAgs DNAgs DNAts DNAgs DNAas DNAas DNAts |
| 1505 | 276227 | 276246 | CTTGGTACATT ATCTTGCAG | ASO-1608 | OxyMCs DNAts DNAts DNAgs DNAgs DNAts DNAcs DNAts DNAgs OxyAs OxyG |
| 1506 | 276472 | 276491 | TACTTGTCCTTT | ASO- | OxyTs OxyAs OxyMCs DNAts DNAas DNAts DNAgs DNAts DNAts DNAcs DNAts DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1506 | 276737 | 276753 | ATCATTAG | 1609 | DNAts DNAas DNAts DNAcs DNAas DNAts DNAts DNAts OxyAs OxyG |
| 1507 | 277053 | 277072 | TGTAAGGTAAA GTCTTT | ASO-1610 | OxyTs OxyGs OxyTs OxyAs DNAas DNAgs DNAgs DNAts DNAas DNAas DNAgs DNAts OxyMCs OxyTs OxyT |
| 1508 | 277421 | 277440 | GTAAGATTAGA CTGTGCTAC | ASO-1611 | OxyGs DNAts DNAas DNAgs DNAts DNAgs DNAcs OxyTs OxyAs OxyMC DNAcs DNAts DNAas DNAgs DNAts DNAts DNAts DNAas OxyAs OxyMC |
| 1509 | 277611 | 277627 | ATTGTATTTCTT GATTTTAC | ASO-1612 | OxyAs OxyTs OxyGs DNAts DNAts DNAts OxyTs OxyTs OxyAs OxyMC DNAts DNAgs DNAas DNAts DNAts OxyTs OxyAs OxyAs DNAgs |
| 1510 | 277919 | 277936 | CCAGGAATAGC TTTAAA | ASO-1613 | OxyMCs OxyMCs OxyAs OxyGs DNAgs DNAas DNAts DNAas DNAgs DNAcs DNAts DNAts OxyTs OxyAs OxyAs OxyA |
| 1511 | 278181 | 278200 | ATCTGAATTTT GTGTTAG | ASO-1614 | OxyAs OxyTs OxyMCs OxyTs DNAgs DNAas DNAts DNAts DNAts DNAts DNAgs DNAts DNAgs DNAts OxyTs OxyAs OxyG |
| 1512 | 278185 | 278203 | TATTATTCTTG TTTTAGCC | ASO-0084 | OxyTs OxyAs DNAts DNAts DNAas DNAts DNAts DNAts DNAts DNAcs DNAts DNAts DNAgs DNAgs OxyMCs OxyMC |
| 1513 | 278624 | 278643 | ACATATTATTTC TTGTTTT | ASO-1615 | OxyAs OxyMCs OxyAs OxyTs DNAgs DNAts DNAgs OxyTs OxyTs OxyT DNAcs DNAts DNAts DNAgs DNAts DNAts |
| 1514 | 278626 | 278644 | TTTAAATGAAT GAATCCAAG | ASO-1616 | OxyTs OxyTs OxyTs OxyAs DNAas DNAts DNAgs DNAas DNAts DNAts DNAgs DNAas DNAts DNAts DNAts DNAcs OxyAs OxyG |
| 1515 | 279074 | 279090 | TTTTAAATGAAT GAATCCA | ASO-1617 | OxyTs OxyTs OxyTs OxyTs DNAas DNAts DNAas DNAts DNAas OxyTs OxyMCs OxyMCs OxyA |
| 1516 | 279461 | 279480 | GATAATATAGC TTTGGC | ASO-1618 | OxyGs OxyAs OxyTs OxyAs DNAas DNAts DNAts DNAts OxyGs OxyGs OxyMC DNAts DNAts DNAts DNAts DNAts DNAts DNAcs |
| 1517 | 279663 | 279679 | TTCAGTTTTCTT AGATGCAT | ASO-1619 | OxyTs OxyTs DNAts DNAcs DNAas DNAgs DNAts DNAts DNAgs OxyMCs OxyAs OxyT DNAts DNAts DNAas DNAts OxyMCs OxyAs OxyA |
| 1518 | 280077 | 280093 | AATGGAGTTGG TGAGCA | ASO-1620 | OxyAs OxyAs OxyTs OxyGs DNAgs DNAts DNAas DNAts DNAgs DNAts DNAas DNAgs DNAts DNAts OxyMCs OxyA |
| 1519 | 280136 | 280152 | GATAACATTTG GTCAGA | ASO-1621 | DNAts DNAgs DNAts OxyMCs OxyAs OxyGs OxyA |
| 1520 | 280658 | 280676 | TCTGGAGGGAT GTAATT | ASO-1622 | OxyTs OxyMCs OxyTs OxyGs DNAas DNAts DNAas DNAgs DNAgs DNAts OxyTs OxyT |
| 1521 | 280662 | 280679 | TCTACCAATTA AATATTTA | ASO-1623 | OxyTs OxyMCs OxyTs OxyAs DNAcs DNAas DNAts DNAts DNAas DNAts DNAts OxyTs OxyAs OxyA |
| 1522 | 281482 | 281499 | TCCTCTACCAA TAAATA | ASO-1624 | OxyTs OxyMCs OxyMCs OxyTs DNAcs DNAts DNAas DNAts DNAts DNAas OxyAs OxyAs OxyTs OxyA |
| 1523 | 281493 | 281509 | CTATGATATGA ATGTATG | ASO-1625 | OxyMCs OxyTs OxyAs OxyTs DNAgs DNAas DNAts DNAts DNAgs DNAts DNAts DNAgs OxyTs OxyAs OxyTs DNAgs |
| 1524 | 282021 | 282039 | TGACTTAATGC TATGAT | ASO-1626 | OxyGs OxyTs OxyGs DNAas DNAts OxyTs DNAts DNAts DNAas DNAts OxyGs OxyGs OxyAs OxyG |
|  |  |  | GTTATTATTATT | ASO- | OxyGs OxyTs OxyTs DNAas DNAts DNAts DNAts DNAts DNAts DNAts DNAas DNAts DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1525 | 282239 | 282258 | TTCAGGT TATGTAGTTTG GGTATTTAT | 1627 | DNAts DNAts DNAts DNAas DNAcs OxyGs OxyGs OxyT OxyTs OxyGs OxyTs OxyGs DNAts DNAas DNAts DNAts DNAgs DNAgs DNAgs DNAgs DNAts DNAts DNAts DNAts OxyAs OxyT |
| 1526 | 282245 | 282261 | CTTTATGTAGTT TGGGT | ASO-0085 ASO-1628 | OxyMCs OxyTs OxyTs DNAts DNAas DNAts DNAgs DNAts DNAas DNAgs DNAts DNAts DNAts DNAgs OxyGs OxyGs OxyT |
| 1527 | 282662 | 282681 | TTAAATTCACAT TTTACTTT | ASO-1629 | OxyTs OxyTs OxyAs OxyAs DNAas DNAts DNAts DNAas OxyMCs OxyTs OxyTs OxyT |
| 1528 | 282946 | 282964 | CTCCATAACAT TTACCATC | ASO-1630 | OxyMCs OxyTs OxyMCs DNAas DNAas DNAts DNAas DNAas OxyTs OxyMC DNAts DNAts DNAas DNAcs DNAcs DNAas DNAcs DNAas |
| 1529 | 282952 | 282969 | ATTCTCTCCAT AACATTT | ASO-1631 | OxyAs OxyTs OxyTs OxyMCs DNAts DNAcs DNAts DNAcs DNAcs DNAas DNAts DNAas DNAas OxyAs OxyTs OxyT |
| 1530 | 283532 | 283549 | TGTTAGTTTTAT TCTCAG | ASO-1632 | OxyTs OxyGs OxyTs DNAts DNAas DNAts DNAts DNAts DNAas DNAts DNAts DNAcs DNAts OxyMCs OxyAs OxyG |
| 1531 | 283823 | 283841 | GACAATAGTAA GAATTTTA | ASO-1633 | OxyGs OxyAs OxyMCs OxyAs DNAas DNAts DNAas DNAgs DNAts OxyTs OxyTs OxyA DNAas DNAgs DNAas DNAas |
| 1532 | 284117 | 284136 | TAAAGGTGTTC TTAGTTTAA | ASO-1634 | OxyTs OxyAs OxyAs OxyAs DNAgs DNAgs DNAts OxyTs OxyTs OxyAs OxyA DNAts DNAts DNAas DNAgs DNAts DNAts DNAas DNAas |
| 1533 | 284473 | 284490 | TCTTGTTGAAA TATTGGG | ASO-1635 | OxyTs OxyMCs OxyTs OxyTs DNAgs DNAts DNAts DNAts OxyGs OxyGs OxyG DNAas DNAts DNAas DNAts DNAas DNAas |
| 1534 | 284474 | 284491 | TTCTTGTTGAA ATATTGG | ASO-1636 | OxyTs OxyTs OxyAs DNAts DNAas DNAts DNAts DNAas OxyTs OxyGs OxyG DNAcs DNAts DNAts DNAas DNAcs DNAts |
| 1535 | 285623 | 285640 | TTGCAAGACTT ATTTAGG | ASO-1637 | OxyTs OxyTs OxyGs OxyMCs DNAts DNAas DNAgs DNAts DNAas OxyGs OxyG DNAts DNAts DNAts DNAts DNAas DNAcs |
| 1536 | 285794 | 285811 | TATGTTGCATT CATCTAT | ASO-1638 | OxyTs OxyAs DNAts DNAgs DNAts DNAts DNAcs OxyTs OxyAs OxyT DNAcs DNAas DNAts DNAas DNAts DNAts |
| 1537 | 285985 | 286002 | GCCAATTTACA AAACATA | ASO-1639 | OxyGs OxyMCs OxyMCs OxyAs DNAas DNAts DNAas DNAts OxyAs OxyA DNAas DNAts DNAts DNAas DNAts DNAcs |
| 1538 | 286389 | 286405 | GCTCTCAGTCA TATTTC | ASO-1640 | OxyGs OxyMCs DNAts DNAcs DNAts DNAas DNAgs DNAts OxyTs OxyMC DNAas DNAts DNAts DNAts DNAts DNAcs |
| 1539 | 286862 | 286881 | GTAGGTTTTAA TTTCTTTCA | ASO-1641 | OxyGs OxyTs OxyGs DNAas DNAgs DNAts DNAts DNAts OxyMCs OxyMCs OxyA DNAas DNAts DNAts DNAts DNAts DNAcs |
| 1540 | 286962 | 286979 | GAGTTAATTTC AAAGTGT | ASO-1642 | OxyGs OxyAs OxyGs DNAts DNAas DNAts DNAts OxyGs OxyGs OxyT DNAas DNAts DNAts DNAcs DNAas |
| 1541 | 287329 | 287348 | TGCTAATCAAT TTTATATTA | ASO-1643 | OxyTs OxyGs OxyMCs OxyTs DNAas DNAas DNAts OxyTs OxyA DNAts DNAts DNAts DNAas DNAts DNAas |
| 1542 | 287332 | 287350 | TCTGCTAATCA ATTTTATA | ASO-0086 | OxyTs OxyMCs OxyTs DNAts DNAas DNAts DNAts OxyAs OxyA DNAas DNAts DNAts DNAts DNAts DNAcs |
| 1543 | 287693 | 287712 | TTAAGAGTTTGA | ASO- | OxyTs DNAts DNAts DNAas DNAas DNAgs DNAts DNAts DNAas OxyTs OxyA DNAas DNAts DNAts DNAgs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1544 | 287941 | 287960 | TGACATGGA | 1644 | DNAts DNAgs DNAas DNAcs DNAas OxyTs OxyGs OxyGs OxyA |
| 1545 | 288096 | 288112 | GTATTATAAA GATTTTCAT | ASO-1645 | OxyGs OxyTs OxyAs OxyTs DNAts DNAts DNAas DNAts DNAas DNAas DNAgs DNAas DNAts DNAts OxyTs OxyMCs OxyAs OxyT |
| 1546 | 288493 | 288510 | GATCATTTAGA ATAAGT | ASO-1646 | OxyGs OxyAs OxyTs OxyMCs DNAas DNAts DNAts DNAts DNAas DNAgs DNAas DNAts DNAts OxyAs OxyGs OxyT |
| 1547 | 288769 | 288786 | TAATGTTGGGG AGAGGAA | ASO-1647 | OxyTs OxyAs DNAas DNAts DNAgs DNAts DNAts DNAgs DNAas DNAgs DNAgs DNAas DNAas OxyGs OxyAs OxyA |
| 1548 | 289061 | 289077 | ACTGACTACTT AATTACT | ASO-1648 | DNAas DNAgs DNAas OxyGs OxyGs DNAas DNAts DNAts DNAas DNAcs DNAts DNAts DNAas DNAts OxyAs OxyMCs OxyT |
| 1549 | 289356 | 289373 | AATATGTCTAG TTCTAT | ASO-1649 | OxyAs OxyAs OxyTs OxyAs DNAts DNAgs DNAts DNAas DNAcs DNAts DNAas DNAgs DNAts DNAts OxyMCs OxyTs OxyAs OxyT |
| 1550 | 289661 | 289678 | TTTTCAGTTGTT TAGATT | ASO-1650 | OxyTs OxyTs OxyTs DNAts DNAas DNAgs DNAts DNAts DNAgs DNAts DNAts DNAts OxyGs OxyAs OxyTs OxyT |
| 1551 | 289937 | 289954 | TGGTTAGACAA TATATAT | ASO-1651 | OxyTs OxyGs OxyGs OxyTs DNAts DNAgs DNAas DNAcs DNAas DNAas DNAts OxyAs OxyTs OxyAs OxyT |
| 1552 | 290501 | 290520 | TCTTTGATAACT GTACTT | ASO-1652 | OxyTs OxyMCs OxyTs OxyTs DNAts DNAgs DNAas DNAts OxyAs OxyMCs OxyTs OxyT |
| 1553 | 290504 | 290521 | ATTTCTAACTG CATTCTAAA | ASO-1653 | OxyAs OxyTs OxyTs OxyTs DNAts DNAts DNAas DNAcs DNAts DNAts DNAcs DNAts OxyTs OxyAs OxyAs OxyA |
| 1554 | 290896 | 290915 | TATTTCTAACTG CATTCT | ASO-1654 | OxyTs OxyAs DNAts DNAts DNAts DNAts DNAcs DNAts DNAas DNAas DNAcs DNAts OxyTs OxyMCs OxyT |
| 1555 | 291057 | 291074 | TGGAAATAATT TAAGTATAA | ASO-1655 | OxyTs OxyGs OxyGs DNAas DNAas DNAas DNAts DNAas DNAas DNAts DNAts DNAas OxyGs OxyTs OxyAs OxyA |
| 1556 | 291849 | 291865 | ATGGCATATAG GAAATGT | ASO-1656 | OxyAs OxyTs OxyGs OxyGs DNAcs DNAas DNAts DNAas DNAts DNAas OxyTs OxyGs OxyT |
| 1557 | 292523 | 292541 | TGAACTCTTCT AAAACC | ASO-1657 | DNAas DNAgs DNAas DNAas DNAas DNAas DNAas OxyMCs OxyMC |
| 1558 | 292632 | 292649 | CTCTCTTGTCTT TTCTACAT | ASO-1658 | OxyMCs DNAts DNAas DNAcs DNAts DNAts DNAgs DNAts DNAcs DNAts DNAas OxyAs OxyT |
| 1559 | 292673 | 292692 | CTTGGTTTAAC AGATAAA | ASO-1659 | OxyMCs OxyTs OxyTs OxyGs DNAgs DNAas OxyTs OxyAs OxyAs OxyA |
| 1560 | 292795 | 292811 | GATTTGGTTAC TATAACAAT | ASO-0087 | OxyGs OxyGs OxyTs DNAts DNAas DNAas OxyMCs OxyMCs OxyAs OxyAs OxyT |
| 1561 | 293377 | 293393 | TGGAAGAGTAA GATAAG | ASO-1660 | OxyTs OxyGs OxyGs DNAas DNAas DNAgs DNAts OxyAs OxyAs OxyG |
| 1562 | 293389 | 293406 | TATAGTAGTCA GCTTGT | ASO-1661 | OxyTs OxyAs OxyTs OxyAs DNAgs DNAts DNAas DNAcs DNAts DNAts OxyGs OxyT |
| | | | TGAATCATTTG | ASO- | OxyTs OxyGs OxyAs DNAts DNAcs DNAas DNAts DNAts DNAts DNAgs |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1563 | 293844 | 293860 | TATATAG AGTTTATAGAG | ASO-1662 | DNAts DNAas DNAT OxyAs OxyTs OxyAs OxyG |
| 1564 | 294150 | 294166 | AGTTTATAGAG TGTGAA | ASO-1663 | OxyAs DNAas OxyGs OxyTs DNAts DNAas DNAts DNAgs DNAas DNAgs DNAts DNAgs OxyTs OxyGs OxyAs OxyA |
| 1565 | 294498 | 294513 | CAGTTAGGCAA TAGGTG | ASO-1664 | OxyMCs DNAas DNAts DNAgs OxyGs DNAts DNAaas DNAgs DNAgs DNAgs OxyTs OxyG |
| 1566 | 294500 | 294516 | TTACTTCATCG AGACT | ASO-1665 | DNAas DNAts DNAts OxyAs OxyMCs DNAts DNAts DNAas DNAts DNAas DNAts DNAmcs |
| 1567 | 294955 | 294973 | ATTTTACTTCAT CGAGA | ASO-1666 | DNAgs DNAas DNAgs OxyAs OxyMC OxyT |
| 1568 | 295332 | 295350 | TTTATTTCTTG TATAGCC | ASO-1667 | OxyTs OxyTs OxyTs OxyAs DNAts DNAts DNAts DNAts DNAcs DNAts DNAts DNAgs DNAts DNAas DNAgs OxyMCs OxyMC |
| 1569 | 295458 | 295477 | AGAAGTGACAT ATGAAATCA | ASO-1668 | OxyAs OxyGs OxyAs DNAgs DNAgs DNAts DNAas OxyAs OxyTs OxyMCs OxyA |
| 1570 | 296319 | 296336 | TATTGAACTTTA TATAATTA | ASO-1669 | OxyTs OxyAs OxyTs DNAgs DNAts DNAas OxyAs OxyTs OxyTs OxyA |
| 1571 | 296320 | 296336 | TCTTGCTTTCG TGCTAAAA | ASO-1670 | OxyTs OxyMCs DNAts DNAts DNAgs DNAcs DNAts DNAts DNAts DNAmcs |
| 1572 | 296320 | 296337 | TCTTGCTTTCG TGCTAA | ASO-1671 | OxyTs OxyMCs DNAts DNAts DNAgs DNAcs DNAts OxyTs OxyAs OxyA |
| 1573 | 296323 | 296341 | CTCTTGCTTTC GTGCTAA | ASO-1672 | OxyMCs DNAts DNAts DNAts DNAts DNAgs DNAcs OxyTs OxyAs OxyA |
| 1574 | 296323 | 296342 | TAATCTCTTGC TTTCGTGC | ASO-1673 | OxyTs DNAas DNAts DNAas DNAmcs DNAgs DNAts OxyGs OxyMC |
| 1575 | 296324 | 296342 | ATAATCTCTTG CTTTCGTGC | ASO-1674 | OxyAs DNAts DNAts DNAts DNAmcs DNAgs DNAts OxyGs OxyMC |
| 1576 | 296324 | 296343 | ATAATCTCTTG CTTTCGTG | ASO-1675 | DNAcs DNAts DNAts DNAts DNAcs OxyGs OxyTs OxyG |
| 1577 | 297079 | 297098 | GATAATCTCTT GCTTTCGTG | ASO-1676 | OxyGs OxyAs DNAts DNAts DNAts DNAmcs DNAgs OxyTs OxyG |
| 1578 | 297079 | 297097 | GAAAACATTTC TTAAGCTGA | ASO-0088 | OxyAs OxyAs OxyAs DNAas OxyMCs DNAts OxyGs OxyA |
| 1579 | 297198 | 297216 | AAAACATTTCT AAGCTGA | ASO-1677 | OxyGs OxyAs OxyAs DNAas DNAas DNAgs DNAcs OxyTs OxyGs OxyA |
| 1580 | 297595 | 297612 | TACAAACATAT AAAGAGA | ASO-1678 | OxyTs OxyAs OxyMCs OxyAs DNAas DNAas DNAcs OxyA |
| 1581 | 297953 | 297971 | CTTTTCAATCAT ATTCAC | ASO-1679 | OxyMCs OxyTs OxyTs OxyTs DNAts DNAas DNAts OxyTs OxyMCs OxyAs OxyMC |
| | | | AATTATAGTATT | ASO- | OxyAs OxyAs OxyTs OxyTs DNAas DNAts DNAas DNAgs DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1582 | 298036 | 298053 | TGCTTCAGTATATATCTT | ASO-1681 | OxyTs OxyGs DNAcs DNAts DNAcs DNAts DNAcs DNAgs DNAts DNAas DNAts DNAas DNAts DNAas OxyTs OxyMCs OxyTs OxyT |
| 1583 | 299320 | 299338 | CAAAGATATTAGTGAACTG | ASO-1682 | OxyMCs DNAas DNAas OxyAs OxyAs DNAgs DNAas DNAts DNAas DNAts DNAgs DNAas OxyAs OxyMCs OxyTs OxyG |
| 1584 | 299326 | 299342 | TAGGCAAAGATATTAGT | ASO-1683 | OxyTs OxyAs OxyGs OxyGs DNAcs DNAas DNAas DNAas DNAgs DNAas DNAas DNAts DNAts DNAas OxyGs OxyT |
| 1585 | 299788 | 299807 | TCCTCTATAAATATGGTTTT | ASO-1684 | OxyTs OxyMCs OxyMCs DNAts DNAcs DNAts DNAas DNAts DNAas DNAgs DNAts DNAas DNAts OxyTs OxyT |
| 1586 | 299887 | 299905 | GCTTAAAATCAAATATATA | ASO-1685 | OxyGs OxyMCs OxyTs DNAas DNAas DNAas DNAts DNAcs DNAas DNAas DNAts OxyAs OxyTs OxyA |
| 1587 | 300239 | 300255 | AAGGTAGATCAAATGGA | ASO-1686 | OxyAs OxyAs OxyGs OxyGs DNAts DNAas DNAgs DNAas DNAts DNAcs DNAas OxyGs OxyA |
| 1588 | 300543 | 300560 | AAGGTTTAAGAGAGGAAG | ASO-1687 | OxyAs OxyAs OxyGs OxyGs DNAts DNAts DNAts DNAas DNAas DNAgs DNAgs OxyAs OxyGs OxyA |
| 1589 | 300798 | 300816 | TATTGTGTTTAAGTTTATT | ASO-0089 | OxyTs OxyAs OxyTs OxyTs DNAgs DNAts DNAgs DNAts DNAts DNAas DNAts DNAas OxyTs OxyT |
| 1590 | 300801 | 300819 | TATTATTGTGTTTAAGTTT | ASO-1688 | OxyTs OxyAs OxyTs OxyTs DNAts DNAas DNAcs DNAas OxyGs OxyTs OxyTs OxyT |
| 1591 | 301617 | 301636 | TTTTGTGTTTCATGTGTAA | ASO-1689 | OxyTs OxyTs OxyTs DNAts DNAgs DNAts DNAgs DNAts DNAts OxyTs OxyAs OxyA |
| 1592 | 301676 | 301694 | AGATTTTCTGTAAAAGAA | ASO-1690 | OxyAs OxyGs OxyAs OxyTs DNAts DNAts DNAts DNAcs DNAts DNAgs DNAts OxyGs OxyAs OxyA |
| 1593 | 301775 | 301793 | GAATAAATGTACCATTTTC | ASO-1691 | OxyGs OxyAs OxyAs OxyTs DNAas DNAas DNAts DNAts DNAts OxyTs OxyTs OxyMC |
| 1594 | 301776 | 301795 | AGGAATAAATGTACCATTTT | ASO-1692 | OxyAs OxyGs OxyGs DNAas DNAas DNAts DNAas DNAas DNAts DNAts DNAas DNAgs DNAts DNAas OxyTs OxyT |
| 1595 | 301777 | 301795 | AGGAATAAATGTACCATTT | ASO-1693 | OxyAs OxyGs OxyGs OxyAs DNAas DNAts DNAas DNAas DNAts DNAgs DNAts DNAas OxyTs OxyT |
| 1596 | 301777 | 301796 | TAGGAATAAATGTACCATTT | ASO-1694 | OxyTs OxyAs OxyGs OxyGs DNAas DNAas DNAts DNAas DNAas DNAts DNAas OxyTs OxyT |
| 1597 | 301778 | 301795 | AGGAATAAATGTACCATT | ASO-1695 | OxyAs OxyGs OxyGs DNAas DNAas DNAts DNAas DNAas DNAts DNAcs OxyMCs OxyAs OxyTs OxyT |
| 1598 | 301778 | 301796 | TAGGAATAAATGTACCATT | ASO-1696 | OxyTs OxyAs OxyGs OxyGs DNAas DNAas DNAts DNAas DNAas DNAts DNAgs DNAts DNAas OxyTs OxyT |
| 1599 | 301778 | 301797 | TTAGGAATAAATGTACCATT | ASO-1697 | OxyTs OxyTs OxyAs OxyGs DNAgs DNAas DNAas DNAts DNAas DNAas OxyMCs OxyAs OxyTs OxyT |
| 1600 | 301779 | 301796 | TAGGAATAAAT... | ASO- | OxyTs OxyAs OxyGs DNAgs DNAas DNAas DNAts DNAas DNAas DNAts |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1601 | 301779 | 301797 | GTACCAT TTAGGAATAAA | 1698 | DNAgs DNAts DNAas OxyMCs OxyAs OxyT |
| 1602 | 301779 | 301798 | TTAGGAATAAA TGTACCAT | ASO-1699 | OxyTs OxyAs DNAgs DNAas DNAgs DNAas DNAts DNAas DNAgs DNAas DNAts DNAas DNAts DNAas OxyMCs OxyAs OxyT |
| 1603 | 301780 | 301797 | ATTAGGAATAA ATGTACCAT | ASO-1700 | OxyAs OxyTs DNAas DNAgs DNAts DNAas OxyMCs OxyAs OxyT |
| 1604 | 301780 | 301798 | TTAGGAATAAA TGTACCA | ASO-1701 | OxyTs OxyAs OxyAs DNAgs DNAas DNAgs DNAas DNAts DNAas DNAgs DNAas DNAts DNAas OxyMCs OxyA |
| 1605 | 301780 | 301799 | ATTAGGAATAA ATGTACCA | ASO-1702 | OxyAs OxyTs OxyTs OxyAs DNAgs DNAas DNAgs DNAas DNAts DNAas DNAgs DNAas DNAts DNAas OxyMCs OxyA |
| 1606 | 301781 | 301798 | AATTAGGAATA AATGTACCA | ASO-1703 | OxyAs OxyAs OxyTs OxyTs DNAas DNAgs DNAas DNAgs DNAas DNAts DNAas DNAgs DNAas DNAts DNAas OxyMCs OxyA |
| 1607 | 301781 | 301799 | ATTAGGAATAA ATGTACC | ASO-1704 | OxyAs OxyTs OxyTs DNAgs DNAas DNAgs DNAas DNAts DNAas DNAgs DNAas DNAts DNAas OxyMC |
| 1608 | 301788 | 301807 | AATTAGGAATA AATGTACC | ASO-1705 | OxyAs OxyAs OxyTs OxyTs DNAas DNAgs DNAas DNAts DNAas DNAgs DNAas DNAts DNAas OxyMC |
| 1609 | 301793 | 301810 | TGTTATTAAAT AGGAATAA | ASO-1706 | OxyTs OxyGs OxyTs OxyTs DNAas DNAts DNAts DNAas DNAas OxyAs OxyTs OxyAs OxyA |
| 1610 | 302323 | 302340 | GCATGTTATTA AATTAGG | ASO-1707 | OxyGs OxyMCs OxyAs OxyTs DNAgs DNAts DNAas DNAts DNAts OxyAs OxyGs OxyG |
| 1611 | 302378 | 302396 | TATATTATACAT TAACTG | ASO-1708 | OxyTs OxyAs OxyAs DNAts OxyAs DNAts DNAas DNAts DNAas OxyMCs OxyTs OxyG |
| 1612 | 302987 | 303005 | TTATATATAGTT TTATGAA | ASO-1709 | OxyTs OxyTs OxyAs DNAts DNAts DNAts DNAas OxyTs OxyGs OxyAs OxyA |
| 1613 | 303219 | 303237 | TCATTAGGTGT AAGGAAAA | ASO-1710 | OxyTs OxyMCs OxyAs DNAas DNAgs DNAts DNAts DNAas DNAgs DNAas OxyAs OxyAs OxyA |
| 1614 | 303388 | 303407 | GTTTATTTGTT GTAAATG | ASO-1711 | OxyGs OxyTs OxyTs OxyTs DNAas DNAts DNAts DNAas OxyAs OxyAs OxyTs OxyG |
| 1615 | 303883 | 303900 | CTGAAATAGGT TAAAATATT | ASO-1712 | OxyMCs OxyTs OxyGs OxyAs DNAas DNAts DNAas DNAts DNAas OxyTs OxyAs OxyTs OxyT |
| 1616 | 304085 | 304101 | ATATCAAGTTT CAGGTAT | ASO-1713 | OxyAs OxyTs OxyAs DNAts DNAas DNAas DNAcs DNAas DNAas OxyGs OxyTs OxyAs OxyT |
| 1617 | 304347 | 304366 | GCTGGAGAGAT ATATT | ASO-1714 | OxyGs OxyMCs OxyTs OxyGs DNAgs DNAas DNAgs DNAas DNAgs DNAas OxyTs OxyTs OxyT |
| 1618 | 304348 | 304366 | AGCTGAAAGAG AAAAACATG | ASO-1715 | OxyAs OxyGs OxyMCs DNAts DNAas DNAas OxyMCs OxyAs OxyTs OxyG |
| 1619 | 304348 | 304367 | AGCTGAAAGAG AAAAACAT AAGCTGAAAGA | ASO-1716 | OxyAs OxyGs OxyMCs OxyGs DNAgs DNAas DNAas OxyMCs OxyAs OxyT |
|  |  |  |  | ASO- | OxyAs OxyAs OxyGs OxyMCs DNAts DNAas DNAgs DNAas DNAgs DNAas OxyAs OxyT |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1620 | 304374 | 304392 | GAAAAACAT TGGATTGGTTT | 1717 | DNAas DNAgs DNAgs DNAas DNAts DNAas OxyAs OxyMCs OxyAs OxyT |
| 1621 | 304458 | 304474 | TGGATTGGTTT ATTGCTTT | ASO-1718 | OxyTs OxyGs DNAgs DNAts DNAts DNAgs DNAgs DNAts DNAts DNAts DNAts DNAgs DNAts DNAgs DNAcs OxyTs OxyTs OxyT |
| 1622 | 304458 | 304474 | CATGTACTGTG TGAGCC | ASO-1719 | OxyMCs OxyAs DNAts DNAas DNAts DNAas DNAts DNAts DNAgs DNAt DNAgs DNAts DNAgs DNAas OxyMCs OxyMC |
| 1623 | 304459 | 304475 | CCATGTACTGT GTGAGC | ASO-1720 | OxyMCs DNAcs DNAas DNAts DNAas DNAts DNAgs DNAas DNAts DNAgs DNAas OxyGs OxyMC |
| 1624 | 304584 | 304600 | TATTTACTTGAT GGGTA | ASO-1721 | DNAts DNAgs OxyAs OxyTs DNAts DNAts DNAas DNAts DNAgs DNAts DNAgs DNAas DNAts DNAgs OxyGs OxyTs OxyA |
| 1625 | 304584 | 304601 | ATATTTACTTGA TGGGTA | ASO-1722 | OxyAs OxyTs OxyAs OxyTs DNAts DNAts DNAas DNAcs DNAts DNAts DNAgs DNAts DNAgs OxyGs OxyTs OxyA |
| 1626 | 304584 | 304602 | AATATTTACTTG ATGGGTA | ASO-1723 | OxyAs OxyAs OxyTs DNAts DNAts DNAts DNAas DNAts DNAas DNAcs DNAts DNAts DNAgs OxyGs OxyTs OxyA |
| 1627 | 304585 | 304602 | AATATTTACTTG ATGGGT | ASO-1724 | OxyAs OxyAs OxyTs DNAas DNAts DNAts DNAts DNAas DNAts DNAts DNAgs OxyGs OxyGs OxyGs OxyT |
| 1628 | 304648 | 304665 | AACAATGGAAT AAGTAGA | ASO-1725 | OxyAs OxyAs OxyMCs OxyAs DNAas DNAts DNAgs DNAgs OxyTs OxyAs OxyGs OxyA |
| 1629 | 304966 | 304984 | CTCCTGATAAT ATATTGGC | ASO-1726 | OxyMCs OxyTs OxyMCs DNAcs DNAts DNAgs DNAas DNAts DNAts DNAts DNAgs OxyGs OxyMC |
| 1630 | 305066 | 305082 | TAGAGTGGTGA GGTGAG | ASO-1727 | OxyTs DNAas DNAgs DNAgs OxyTs OxyGs OxyAs OxyG |
| 1631 | 305517 | 305534 | CCTATTTTCAAT TATTCC | ASO-1728 | OxyMCs OxyMCs OxyAs OxyTs DNAgs DNAts DNAts DNAts DNAcs OxyMC |
| 1632 | 305595 | 305613 | AAGAGATCAAC AGTGGACC | ASO-0090 | DNAas DNAts DNAts DNAas DNAts DNAgs DNAas DNAcs DNAas DNAas DNAcs DNAas DNAts DNAcs DNAas OxyMC |
| 1633 | 305842 | 305859 | TTGGGAATAAA TTTCAGC | ASO-1729 | OxyTs OxyTs OxyGs DNAgs DNAgs DNAas DNAts DNAas DNAts DNAts DNAas DNAas OxyAs OxyMC |
| 1634 | 305982 | 305998 | TACTGTATGAA TGTAAC | ASO-1730 | OxyTs OxyAs OxyMCs OxyTs DNAgs DNAts DNAas DNAts DNAts DNAas DNAas OxyTs OxyAs OxyTs OxyT |
| 1635 | 306082 | 306098 | AGAAGCCCCAT TTAAGC | ASO-1731 | OxyAs DNAas DNAts DNAas DNAgs DNAas DNAcs DNAas DNAts DNAts DNAas OxyGs OxyMC |
| 1636 | 306087 | 306104 | ATTAAGAGAAG CCCCATT | ASO-1732 | OxyAs DNAts DNAts DNAas DNAcs DNAcs DNAcs DNAas OxyMCs OxyAs OxyTs OxyT |
| 1637 | 306087 | 306105 | TATTAAGAGAA GCCCCATT | ASO-1733 | OxyTs DNAts DNAts DNAts DNAcs DNAcs DNAas OxyMCs OxyAs OxyTs OxyT |
| 1638 | 306088 | 306104 | ATTAAGAGAAG CCCCAT | ASO-1734 | OxyAs DNAts DNAas DNAts DNAcs DNAcs OxyMCs OxyMCs OxyAs OxyA |
|  | 306088 | 306105 | TATTAAGAGAA | ASO- | OxyTs DNAts DNAts DNAgs DNAts DNAas DNAgs DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1639 | 306088 | 306106 | GCCCCAT | 1735 | DNAas DNAgs DNAts DNAcs DNAcs OxyMCs OxyAs OxyT |
| 1640 | 306089 | 306106 | CTATTAAGAGA AGCCCCAT | ASO-1736 | OxyMCs DNAts DNAas DNAts DNAas DNAgs DNAas DNAgs DNAas DNAgs DNAas DNAgs DNAcs DNAcs OxyMCs OxyAs OxyT |
| 1641 | 306089 | 306105 | TATTAAGAGAA GCCCCA | ASO-1737 | OxyTs OxyAs DNAts DNAts DNAas DNAas DNAgs DNAas DNAgs DNAas DNAgs DNAas DNAcs OxyMCs OxyA |
| 1642 | 306089 | 306106 | CTATTAAGAGA AGCCCCA | ASO-1738 | OxyMCs DNAts DNAas DNAts DNAas DNAcs DNAcs OxyMCs OxyMCs OxyA |
| 1643 | 306090 | 306106 | CTATTAAGAGA AGCCCC | ASO-1739 | DNAas DNAas DNAgs DNAas DNAgs DNAas DNAgs DNAas DNAgs DNAas DNAgs DNAas DNAcs OxyMCs OxyMC |
| 1644 | 306090 | 306107 | CCTATTAAGAG AAGCCCC | ASO-1740 | OxyMCs DNAas DNAts DNAas DNAgs DNAas DNAcs DNAcs OxyMCs OxyMC |
| 1645 | 306091 | 306107 | CCTATTAAGAG AAGCCC | ASO-1741 | OxyMCs DNAcs DNAts DNAas DNAgs OxyMCs OxyMCs OxyMC |
| 1646 | 306091 | 306108 | GCCTATTAAGA GAAGCCC | ASO-1742 | OxyGs DNAas DNAcs DNAas DNAts DNAas DNAts DNAas DNAgs DNAas OxyMCs OxyMC |
| 1647 | 306092 | 306108 | GCCTATTAAGA GAAGCC | ASO-1743 | OxyGs DNAas DNAcs DNAas OxyAs OxyGs OxyMCs OxyMC |
| 1648 | 306109 | 306126 | CATTTGGAATA CAGGGTG | ASO-1744 | OxyMCs OxyAs OxyTs DNAts DNAas DNAgs DNAas OxyGs OxyTs OxyG |
| 1649 | 306110 | 306126 | CATTTGGAATA CAGGGT | ASO-1745 | OxyMCs OxyAs OxyTs OxyTs DNAts DNAas DNAgs DNAas OxyGs OxyGs OxyT |
| 1650 | 306471 | 306488 | ATTTACTTTTGA TGTGAA | ASO-1746 | OxyAs OxyTs OxyTs OxyTs DNAts DNAas DNAts DNAgs OxyTs OxyGs OxyAs OxyA |
| 1651 | 306687 | 306704 | TTTAAATTTCAG CTTGAC | ASO-1747 | OxyTs OxyTs DNAts DNAas DNAas DNAts DNAts DNAas DNAts OxyGs OxyAs OxyMC |
| 1652 | 306870 | 306887 | ATTTGTTAAAA GCTCTGA | ASO-1748 | OxyAs OxyTs OxyTs DNAts DNAgs DNAts DNAts DNAas DNAas DNAas OxyGs OxyA |
| 1653 | 307270 | 307287 | TATGTATAAGA GATGTTT | ASO-1749 | OxyTs OxyAs OxyTs OxyGs DNAts DNAas DNAas DNAas OxyGs OxyTs OxyT |
| 1654 | 307498 | 307515 | ATGCACTCAGA AACATGC | ASO-1750 | OxyAs DNAts DNAgs DNAcs OxyAs DNAas DNAas OxyAs OxyTs OxyGs OxyMC |
| 1655 | 307499 | 307517 | TCATGCACTCA GAAACATG | ASO-1751 | OxyTs OxyMCs OxyAs DNAts DNAgs DNAcs DNAas DNAas OxyAs OxyTs OxyG |
| 1656 | 307500 | 307517 | TCATGCACTCA GAAACAT | ASO-1752 | OxyTs OxyMCs OxyMCs OxyAs DNAts DNAgs DNAcs DNAas OxyMCs OxyAs OxyT |
| 1657 | 307500 | 307518 | TTCATGCACTC AGAAACAT | ASO-1753 | OxyTs OxyTs OxyMCs OxyMCs OxyAs DNAts DNAas DNAcs DNAas DNAcs OxyAs OxyT |
|  | 307584 | 307600 | GTTGAAGTGTA | ASO- | OxyGs OxyTs OxyTs OxyGs DNAas DNAas DNAgs DNAts DNAgs DNAts DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1658 | 307687 | 307703 | AACAAT TGATGAAGAGT TGTACT | ASO-1754 | DNAas DNAas OxyMCs OxyAs OxyAs OxyT |
| 1659 | 308035 | 308052 | GATGTGAATTT TTCCAGT | ASO-1755 | OxyTs OxyGs OxyAs DNAts DNAgs DNAas DNAgs DNAas DNAgs DNAts DNAts DNAgs OxyTs OxyAs OxyMCs OxyT |
| 1660 | 308141 | 308158 | ACAGGATAAAG AAAAGAG | ASO-1756 | OxyGs DNAas DNAts DNAcs OxyMCs OxyAs OxyGs OxyT DNAts DNAts DNAcs OxyMCs OxyAs DNAgs DNAts DNAts DNAts |
| 1661 | 308374 | 308393 | ATTATAAACCTT TAAAATCT | ASO-1757 | OxyAs OxyMCs OxyAs OxyGs DNAgs DNAts DNAts DNAas DNAgs DNAas DNAas OxyAs OxyGs OxyAs OxyG |
| 1662 | 308896 | 308912 | AGGACTGTGAA TTACTA | ASO-1758 | OxyAs OxyTs OxyTs OxyAs DNAts DNAas DNAas DNAcs DNAts DNAts DNAas DNAas OxyAs OxyTs OxyMCs OxyT |
| 1663 | 309052 | 309069 | ATCAGAAAAGC TTCAACC | ASO-1759 | OxyAs OxyGs OxyGs DNAas DNAcs DNAts DNAgs DNAts DNAas DNAas DNAts DNAts DNAas OxyMCs OxyTs OxyA |
| 1664 | 309052 | 309070 | TATCAGAAAAG CTTCAACC | ASO-1760 | OxyAs OxyTs OxyMCs DNAas DNAts DNAcs OxyAs OxyAs OxyMCs OxyMC DNAcs DNAts DNAts DNAcs DNAts DNAgs DNAas DNAas DNAgs |
| 1665 | 309052 | 309071 | TTATCAGAAAA GCTTCAACC | ASO-1761 | OxyTs OxyAs DNAts DNAcs DNAts DNAts DNAcs OxyAs OxyAs OxyMCs OxyMC DNAgs DNAcs DNAts DNAts DNAcs OxyAs OxyAs OxyMCs OxyMC DNAgs DNAcs DNAts DNAts DNAcs OxyAs OxyGs OxyAs OxyMC |
| 1666 | 309053 | 309070 | TATCAGAAAAG CTTCAAC | ASO-1762 | OxyTs OxyAs OxyTs OxyAs DNAts DNAcs OxyAs OxyAs OxyMCs OxyMC DNAgs DNAcs DNAts DNAts DNAcs OxyAs OxyAs OxyMC |
| 1667 | 309053 | 309071 | TTATCAGAAAA GCTTCAAC | ASO-1763 | OxyTs OxyAs OxyTs OxyAs DNAts DNAcs OxyAs OxyAs OxyMC |
| 1668 | 309053 | 309072 | ATTATCAGAAA AGCTTCAAC | ASO-1764 | OxyAs OxyTs OxyTs OxyAs DNAts OxyTs DNAts DNAcs OxyMCs OxyAs OxyAs OxyTs OxyMC |
| 1669 | 309054 | 309072 | ATTATCAGAAA AGCTTCAA | ASO-1765 | OxyAs OxyTs OxyTs OxyAs DNAts OxyTs DNAts DNAcs OxyMCs OxyAs OxyAs OxyTs OxyMC |
| 1670 | 309056 | 309074 | TAATTATCAGA AAAGCTTC | ASO-1766 | OxyAs OxyTs OxyAs OxyAs DNAts OxyTs DNAts DNAas DNAgs OxyMCs OxyAs OxyAs OxyMC |
| 1671 | 309057 | 309074 | TAATTATCAGA AAAGCTT | ASO-1767 | OxyTs OxyAs OxyAs OxyAs DNAts OxyTs DNAts DNAas DNAgs OxyMCs OxyTs OxyT |
| 1672 | 309065 | 309082 | TTGTGTAATAAT TATCAG | ASO-1768 | OxyTs OxyTs OxyGs OxyTs DNAgs DNAts DNAas DNAas DNAts OxyAs OxyMCs OxyAs OxyG |
| 1673 | 309383 | 309402 | TAGAAGATAAT AAATGTGTA | ASO-1769 | OxyTs OxyTs OxyGs OxyTs DNAgs DNAts DNAas DNAas DNAts DNAts OxyAs OxyMCs OxyAs OxyG |
| 1674 | 309427 | 309443 | ATATACAGTGT CCCATG | ASO-1770 | OxyTs OxyTs OxyAs OxyTs DNAas DNAgs DNAas DNAgs OxyAs OxyTs OxyAs OxyA |
| 1675 | 309427 | 309444 | TATATACAGTG TCCCATG | ASO-1771 | OxyAs OxyTs DNAts DNAas DNAts DNAcs OxyMCs OxyAs OxyTs OxyG |
| 1676 | 309428 | 309444 | TATATACAGTG TCCCATG | ASO-1772 | OxyTs DNAts DNAas DNAcs DNAcs OxyMCs OxyAs OxyTs OxyG |
| | | | TATATACAGTG | ASO- | OxyTs OxyAs OxyTs DNAts DNAas DNAcs DNAcs OxyMCs OxyAs OxyTs OxyG |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1677 | | | TCCCAT | 1773 | DNAts DNAcs DNAcs OxyMCs OxyAs OxyT |
| 1678 | 309473 | 309490 | TAACTCTTAAAT ATATCA | ASO-1774 | OxyTs OxyAs OxyAs OxyMCs DNAts DNAcs DNAts DNAts DNAaas DNAts DNAas DNAts DNAas DNAts DNAaas DNAts OxyAs OxyTs OxyMCs OxyA |
| 1679 | 309473 | 309491 | TTAACTCTTAAA TATATCA | ASO-1775 | OxyTs OxyTs OxyAs OxyAs DNAts DNAcs DNAts DNAcs DNAts DNAas OxyTs OxyMCs OxyA DNAas DNAts DNAas DNAts DNAas DNAts DNAas DNAts DNAaas DNAts DNAaas |
| 1680 | 309473 | 309492 | ATTAACTCTTAA ATATATCA | ASO-1776 | OxyAs OxyTs OxyTs OxyAs DNAas DNAcs DNAts DNAcs DNAts DNAas OxyTs OxyMCs OxyA DNAas DNAts DNAas DNAts DNAas DNAts DNAas DNAts DNAaas DNAts DNAaas |
| 1681 | 309474 | 309492 | ATTAACTCTTAA ATATATC | ASO-1777 | ATTAACTCTTAA ATATATC OxyAs OxyTs OxyTs OxyAs DNAas DNAcs DNAts DNAcs DNAts DNAas OxyTs OxyAs OxyTs OxyMC DNAas DNAts DNAas DNAts DNAas DNAts DNAas DNAts DNAts |
| 1682 | 309474 | 309493 | TATTAACTCTTA AATATATC | ASO-1778 | OxyTs OxyAs OxyTs OxyTs DNAts DNAas DNAcs DNAts DNAas OxyTs OxyAs OxyTs OxyMC DNAas DNAts DNAas DNAts DNAas DNAts DNAcs DNAts DNAts |
| 1683 | 309476 | 309494 | TTATTAACTCTT AAATATA | ASO-1779 | OxyTs OxyTs OxyAs OxyTs DNAts DNAas OxyTs OxyAs OxyTs OxyA DNAts DNAas DNAts DNAas DNAts DNAas DNAts DNAcs DNAts DNAts |
| 1684 | 309476 | 309495 | TTTATTAACTCT TAAATATA | ASO-1780 | OxyTs OxyTs OxyAs OxyTs DNAts DNAas DNAcs DNAts DNAas OxyTs OxyAs OxyTs OxyA DNAts DNAas DNAts DNAas DNAts DNAas DNAts DNAcs DNAts DNAts |
| 1685 | 309482 | 309500 | ACAAATTTATTA ACTCTTA | ASO-1781 | OxyAs OxyMCs OxyAs OxyAs DNAts DNAts DNAts DNAts DNAas OxyTs OxyTs OxyA DNAas DNAts DNAas DNAts DNAts OxyMCs OxyTs OxyTs OxyA |
| 1686 | 309482 | 309501 | CACAAATTTATT AACTCTTA | ASO-1782 | OxyMCs OxyAs OxyMCs OxyAs OxyAs DNAas DNAts DNAts DNAas OxyTs OxyTs OxyA DNAts DNAts DNAas DNAts OxyMCs OxyTs OxyTs OxyA |
| 1687 | 309483 | 309501 | CACAAATTTATT AACTCTT | ASO-1783 | OxyMCs OxyAs OxyMCs OxyAs OxyAs DNAas DNAts DNAts DNAas OxyTs OxyTs OxyT DNAts DNAts DNAas DNAts DNAts OxyMCs OxyTs OxyT |
| 1688 | 309483 | 309502 | TCACAAATTTAT TAACTCTT | ASO-1784 | OxyTs OxyMCs OxyAs OxyAs OxyMCs OxyAs OxyAs DNAas DNAts DNAts DNAas OxyTs OxyMCs OxyTs OxyT DNAts DNAts DNAas DNAts DNAts OxyMCs OxyTs OxyT |
| 1689 | 309484 | 309501 | CACAAATTTATT AACTCT | ASO-1785 | OxyMCs OxyAs OxyMCs OxyAs OxyAs DNAas DNAts DNAts DNAas OxyTs OxyMCs OxyT DNAts DNAts DNAas DNAts DNAts OxyMCs OxyT |
| 1690 | 309484 | 309502 | TCACAAATTTAT TAACTCT | ASO-1786 | OxyTs OxyMCs OxyAs OxyAs OxyMCs OxyAs OxyAs DNAas DNAts DNAts DNAas OxyTs OxyMCs OxyT DNAts DNAts DNAas DNAts DNAts OxyMCs OxyT |
| 1691 | 309484 | 309503 | ATCACAAATTTA TTAACTCT | ASO-1787 | OxyAs OxyTs OxyMCs OxyAs OxyAs OxyMCs OxyAs OxyAs DNAts DNAts DNAas OxyTs OxyMCs OxyTs OxyT DNAts DNAts DNAas DNAts DNAas OxyTs OxyMCs OxyTs OxyT |
| 1692 | 309485 | 309502 | TCACAAATTTAT TAACTC | ASO-1788 | OxyTs OxyMCs OxyAs OxyAs OxyMCs OxyAs OxyAs DNAcs DNAts DNAts DNAas OxyTs OxyMC DNAts DNAts DNAas DNAts DNAts OxyMC |
| 1693 | 309485 | 309503 | ATCACAAATTTA TTAACTC | ASO-1789 | OxyAs OxyTs OxyMCs OxyAs OxyAs OxyMCs OxyAs OxyAs DNAcs DNAts DNAts DNAas OxyTs OxyMC DNAts DNAts DNAas DNAts DNAas OxyTs OxyMC |
| 1694 | 309485 | 309504 | AATCACAAATTT ATTAACTC | ASO-1790 | OxyAs OxyAs OxyTs OxyMCs OxyAs OxyAs OxyMCs OxyAs OxyAs OxyMCs OxyAs OxyAs OxyMCs OxyTs OxyMC DNAts DNAts DNAas DNAts DNAas DNAts DNAas OxyTs OxyMC |
| 1695 | 309489 | 309508 | CAGAAATCACA AATTTATTA | ASO-1791 | OxyMCs OxyAs OxyGs OxyAs DNAts DNAas DNAts DNAas DNAts DNAcs DNAcs DNAts OxyTs OxyTs OxyA DNAas DNAts DNAas DNAts DNAas OxyTs OxyTs OxyA |
| | 309490 | 309509 | GCAGAAATCAC | ASO- | OxyGs OxyMCs OxyAs OxyGs DNAas DNAts DNAas DNAts DNAcs DNAts DNAas DNAts DNAts DNAas DNAas |

FIG. 1A (cont.)

| SEQ ID No. | Start (SEQ ID NO: 1) | End (SEQ ID NO: 1) | ASO Sequence | ASO No. | ASO with Chemical Structure |
|---|---|---|---|---|---|
| 1696 | 309491 | 309510 | AAATTTATT | 1792 | DNAcs DNAas DNAas DNAts DNAts DNAts DNAts OxyTs OxyT |
| 1697 | 309491 | 309510 | AGCAGAAATCA CAAATTTAT | ASO-0091 | OxyAs OxyGs OxyMCs DNAas DNAgs DNAas DNAas DNAts DNAts DNAcs DNAas DNAcs DNAas DNAas DNAts OxyTs OxyAs OxyT |
| 1698 | 309491 | 309509 | GCAGAAATCAC AAATTTAT | ASO-0092 | OxyGs OxyMCs OxyAs DNAgs DNAas DNAas DNAts DNAts DNAts DNAcs DNAas DNAas DNAas DNAts OxyTs OxyAs OxyT |
| 1699 | 309492 | 309511 | CAGCAGAAATC ACAAATTTA | ASO-0093 | OxyAs OxyGs OxyMCs DNAas DNAgs DNAas DNAas DNAts DNAts DNAts DNAcs DNAas DNAas DNAas OxyTs OxyTs OxyA |
| 1700 | 309492 | 309510 | AGCAGAAATCA CAAATTTA | 1793 | OxyMCs OxyAs OxyGs DNAas DNAgs DNAas DNAas DNAts DNAts DNAcs DNAas DNAas DNAas OxyTs OxyTs OxyA |
| 1701 | 309493 | 309511 | CAGCAGAAATC ACAAATTT | 1794 | OxyMCs OxyAs OxyGs OxyMCs DNAas DNAgs DNAas DNAas DNAts DNAts DNAcs DNAas DNAas DNAts OxyTs OxyTs OxyT |
| 1702 | 309493 | 309512 | TCAGCAGAAAT CACAAATTT | 1795 | OxyTs OxyMCs OxyAs OxyGs DNAcs DNAas DNAas DNAts DNAgs DNAas DNAas OxyTs OxyTs OxyT |
| 1703 | 309494 | 309512 | TCAGCAGAAAT CACAAATT | 1796 | OxyTs OxyMCs OxyAs DNAcs DNAas DNAas DNAts DNAgs DNAas DNAas OxyAs OxyTs OxyT |
| 1704 | 309494 | 309513 | GTCAGCAGAAA TCACAAATT | 1797 | OxyGs OxyTs OxyMCs DNAas DNAcs DNAas DNAts DNAgs DNAas DNAas OxyAs OxyTs OxyT |
| 1705 | 309495 | 309513 | GTCAGCAGAAA TCACAAAT | 1798 | OxyGs OxyTs OxyMCs OxyAs DNAcs DNAas DNAts DNAgs DNAas DNAas OxyAs OxyAs OxyT |
| 1706 | 309495 | 309514 | TGTCAGCAGAA ATCACAAAT | 1799 | OxyTs OxyGs OxyTs OxyMCs DNAas DNAcs DNAas DNAts DNAgs DNAas DNAas OxyAs OxyAs OxyT |
| 1707 | 309496 | 309513 | GTCAGCAGAAA TCACAAA | 1800 | OxyGs OxyTs OxyMCs OxyAs DNAgs DNAcs DNAas OxyMCs DNAas DNAcs DNAas OxyAs OxyAs OxyA |
| 1708 | 309496 | 309514 | TGTCAGCAGAA ATCACAAA | 1801 | OxyTs OxyGs OxyTs OxyMCs OxyAs DNAcs DNAas OxyMCs DNAas DNAcs DNAas OxyAs OxyAs OxyA |
| 1709 | 309497 | 309514 | TGTCAGCAGAA ATCACAA | 1802 | OxyTs OxyGs OxyTs OxyMCs DNAas DNAcs DNAas DNAcs DNAas OxyAs OxyA |
| 1710 | 310121 | 310138 | GAGAGGTAAAT ACAATCT | 1803 | OxyGs OxyAs OxyGs OxyAs DNAgs DNAas DNAts DNAas DNAgs DNAts OxyMCs OxyT |
| 1711 | 310122 | 310140 | AGGAGAGGTAA ATACAATC | ASO-0094 | OxyAs OxyGs OxyGs OxyAs DNAgs DNAas DNAas OxyAs OxyTs OxyMC |
| 1712 | 310224 | 310241 | TAGGAATGCAA TGATGAA | 1804 | OxyTs OxyGs OxyGs DNAas DNAts DNAgs DNAas DNAgs OxyAs OxyA |
| 1713 | 310486 | 310503 | ATCATTCTAGT CACTCTG | 1805 | OxyAs DNAts DNAcs DNAas DNAts DNAts DNAcs OxyTs OxyMCs OxyTs OxyG |
| | 310832 | 310849 | GTGTCATCTAT GTTTACC | 1806 | OxyTs OxyAs OxyGs OxyTs DNAas DNAts DNAts DNAgs DNAas OxyGs OxyAs OxyT |

FIG. 1B

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 225 | 56869 | 56886 | 119837 | 119854 | -- | -- | TAAAAAGTGGTAGATTCC | ASO-0293 | OxyTs OxyAs OxyAs OxyGs DNAAs DNAas DNAgs DNAts DNAas DNAgs DNAas OxyTs OxyTs OxyMCs OxyMC |
| 226 | 56869 | 56887 | 119837 | 119855 | -- | -- | TTAAAAAGTGGTAGATTCC | ASO-0295 | OxyTs OxyTs OxyAs OxyAs OxyGs DNAAs DNAas DNAgs DNAgs DNAts DNAas DNAgs DNAas OxyTs OxyTs OxyMCs OxyMC |
| 265 | 69183 | 69202 | 69439 | 69458 | -- | -- | ATATTCATACATACATATTC | ASO-0333 | OxyAs OxyTs OxyAs OxyTs DNAts DNAcs DNAas DNAts DNAas DNAcs DNAas DNAts DNAas OxyAs OxyTs OxyTs OxyMC |
| 287 | 76153 | 76170 | 77746 | 77763 | -- | -- | AGAGAATGAAAGTCTACA | ASO-0354 | OxyAs OxyGs OxyAs DNAgs DNAas DNAas DNAts DNAas DNAas DNAts DNAgs DNAas DNAas OxyTs OxyAs OxyMCs OxyA |
| 288 | 76153 | 76171 | 77746 | 77764 | -- | -- | CAGAGAATGAAAGTCTACA | ASO-0356 | OxyMCs OxyAs OxyGs DNAgs DNAas DNAas DNAts DNAas DNAas DNAts DNAgs DNAas DNAas OxyTs OxyAs OxyMCs OxyA |
| 289 | 76153 | 76172 | 77746 | 77765 | -- | -- | CCAGAGAATGAAAGTCTACA | ASO-0358 | OxyMCs OxyMCs OxyAs DNAgs DNAas DNAas DNAts DNAas DNAas DNAts DNAgs DNAas DNAas OxyTs OxyAs OxyMCs OxyA |
| 290 | 76154 | 76171 | 77747 | 77764 | -- | -- | CAGAGAATGAAAGTCTAC | ASO-0360 | OxyMCs OxyAs OxyGs OxyAs DNAgs DNAas DNAas DNAts DNAas DNAas DNAts DNAgs DNAas OxyTs OxyAs OxyMC |
| 291 | 76154 | 76172 | 77747 | 77765 | -- | -- | CCAGAGAATGAAAGTCTAC | ASO-0362 | OxyMCs OxyMCs OxyAs OxyAs DNAgs DNAas DNAas DNAts DNAas DNAas DNAts DNAgs DNAas DNAcs OxyTs OxyAs OxyMC |
| 292 | 76154 | 76173 | 77747 | 77766 | -- | -- | ACCAGAGAATGAAAGTCTAC | ASO-0364 | OxyAs OxyMCs OxyMCs OxyAs OxyAs DNAgs DNAas DNAas DNAts DNAas DNAas DNAts DNAgs DNAts OxyAs OxyMC |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 293 | 76155 | 76172 | 77748 | 77765 | -- | -- | CCAGAGAATG AAAGTCTA | ASO-0366 | OxyMCs OxyMCs OxyAs DNAgs DNAas DNAgs DNAas DNAgs DNAas DNAts DNAgs DNAas DNAas DNAgs DNAas DNAts OxyMCs OxyTs OxyA |
| 294 | 76155 | 76173 | 77748 | 77766 | -- | -- | ACCAGAGAAT GAAAGTCTA | ASO-0368 | OxyAs OxyMCs OxyMCs OxyAs DNAgs DNAas DNAgs DNAas DNAas DNAgs DNAas DNAgs DNAas DNAts DNAgs DNAas DNAas DNAgs DNAts DNAcs OxyTs OxyA |
| 295 | 76155 | 76174 | 77748 | 77767 | -- | -- | AACCAGAGAA TGAAAGTCTA | ASO-0370 | OxyAs OxyAs OxyMCs OxyMCs DNAcs DNAas DNAgs DNAas DNAgs DNAas DNAgs DNAas DNAas DNAgs DNAas DNAts DNAgs DNAas DNAgs OxyTs OxyA |
| 296 | 76156 | 76173 | 77749 | 77766 | -- | -- | ACCAGAGAAT GAAAGTCT | ASO-0372 | OxyAs OxyMCs OxyMCs OxyAs DNAgs DNAas DNAgs DNAas DNAgs DNAas DNAas DNAgs DNAas DNAts DNAgs DNAts DNAts OxyMCs OxyT |
| 297 | 76156 | 76174 | 77749 | 77767 | -- | -- | AACCAGAGAA TGAAAGTCT | ASO-0374 | OxyAs OxyAs OxyMCs OxyMCs OxyAs DNAgs DNAas DNAgs DNAas DNAgs DNAas DNAas DNAgs DNAas DNAts DNAgs DNAts OxyMCs OxyT |
| 298 | 76157 | 76173 | 77750 | 77766 | -- | -- | ACCAGAGAAT GAAAGTC | ASO-0376 | OxyAs OxyMCs OxyMCs OxyAs DNAgs DNAas DNAgs DNAas DNAgs DNAas DNAas DNAgs DNAas OxyGs OxyTs OxyMC |
| 299 | 76157 | 76174 | 77750 | 77767 | -- | -- | AACCAGAGAA TGAAAGTC | ASO-0378 | OxyAs OxyAs OxyMCs OxyMCs OxyAs DNAgs DNAas DNAgs DNAas DNAgs DNAas DNAas DNAgs DNAas OxyAs OxyGs OxyTs OxyMC |
| 300 | 76157 | 76175 | 77750 | 77768 | -- | -- | GAACCAGAGA ATGAAAGTC | ASO-0380 | OxyGs OxyAs OxyAs OxyMCs OxyMCs DNAcs DNAas DNAgs DNAas DNAgs DNAas DNAgs DNAas DNAas OxyAs OxyGs OxyTs OxyMC |
| 301 | 76158 | 76175 | 77751 | 77768 | -- | -- | GAACCAGAGA ATGAAAGT | ASO-0382 | OxyGs OxyAs OxyAs OxyMCs DNAcs DNAas DNAgs DNAas DNAgs DNAas DNAgs DNAas DNAas OxyAs OxyGs OxyT |
| 302 | 76159 | 76178 | 77752 | 77771 | -- | -- | ATGGAACCAG AGAATGAAAG | ASO-0384 | OxyAs OxyTs OxyGs DNAgs DNAas DNAgs DNAgs DNAas OxyAs DNAcs DNAas DNAas DNAts DNAas DNAgs DNAas OxyAs |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 303 | 76160 | 76178 | 77753 | 77771 | -- | -- | ATGGAACCAG AGAATGAAAA | ASO-0386 | OxyAs OxyTs OxyGs OxyGs DNAas DNAas DNAcs DNAas DNAgs DNAas DNAgs DNAas DNAts DNAts DNAgs OxyAs OxyAs OxyA OxyG |
| 385 | 102012 | 102028 | 103215 | 103231 | -- | -- | AATGTAACTTG TTGAGT | ASO-0463 | OxyAs OxyAs OxyTs OxyGs DNAts DNAas DNAas DNAcs DNAts DNAas DNAts DNAts OxyGs OxyAs OxyGs OxyT |
| 386 | 102012 | 102029 | 103215 | 103232 | -- | -- | AAATGTAACTT GTTGAGT | ASO-0465 | OxyGs OxyAs OxyAs OxyTs DNAgs DNAts DNAas DNAas DNAts DNAts DNAts OxyGs OxyAs OxyGs OxyT |
| 387 | 102012 | 102030 | 103215 | 103233 | -- | -- | GAAATGTAACT TGTTGAGT | ASO-0467 | OxyGs OxyAs OxyAs OxyAs DNAts DNAgs DNAts DNAas DNAas DNAts DNAts OxyGs OxyAs OxyGs OxyT |
| 388 | 102012 | 102031 | 103215 | 103234 | -- | -- | AGAAATGTAAC TTGTTGAGT | ASO-0469 | OxyAs OxyGs OxyAs OxyAs DNAts DNAgs DNAts DNAas DNAas DNAts DNAts OxyGs OxyAs OxyGs OxyT |
| 389 | 102013 | 102029 | 103216 | 103232 | -- | -- | AAATGTAACTT GTTGAG | ASO-0471 | OxyAs OxyAs OxyAs OxyTs DNAgs DNAts DNAas DNAas DNAts DNAts OxyTs OxyGs OxyAs OxyG |
| 390 | 102013 | 102030 | 103216 | 103233 | -- | -- | GAAATGTAACT TGTTGAG | ASO-0473 | OxyGs OxyAs OxyAs OxyAs DNAts DNAgs DNAts DNAas DNAts DNAts OxyTs OxyGs OxyAs OxyG |
| 391 | 102013 | 102031 | 103216 | 103234 | -- | -- | AGAAATGTAA CTTGTTGAG | ASO-0475 | OxyGs OxyAs OxyGs OxyAs DNAas DNAts DNAgs DNAts DNAas DNAts DNAts OxyTs OxyGs OxyAs OxyG |
| 392 | 102013 | 102032 | 103216 | 103235 | -- | -- | TAGAAATGTAA CTTGTTGAG | ASO-0477 | OxyTs OxyAs OxyGs OxyAs DNAas DNAas DNAts DNAgs DNAts DNAas DNAcs DNAts DNAts OxyGs OxyG |
| 393 | 102014 | 102031 | 103217 | 103234 | -- | -- | AGAAATGTAA CTTGTTGA | ASO-0479 | OxyAs OxyGs OxyAs OxyAs DNAas DNAts DNAgs DNAts DNAas DNAcs DNAts DNAts OxyTs OxyGs OxyA |
| 394 | 102014 | 102032 | 103217 | 103235 | -- | -- | TAGAAATGTAA | ASO- | OxyTs OxyAs OxyGs OxyAs DNAas DNAas |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| | | | | | | | CTTGTTGA | 0481 | DNAts DNAgs DNAts DNAas DNAas DNAts DNAgs DNAts OxyTs OxyGs OxyA |
| 395 | 102014 | 102033 | 103217 | 103236 | --- | --- | CTAGAAATGTA ACTTGTTGA | ASO-0483 | OxyMCs OxyTs OxyAs DNAgs DNAas DNAas DNAts DNAas DNAgs DNAts DNAas DNAcs DNAts DNAts DNAgs DNAts OxyTs OxyGs OxyA |
| 396 | 102015 | 102032 | 103218 | 103235 | --- | --- | TAGAAATGTAA CTTGTTG | ASO-0485 | OxyTs OxyAs OxyGs OxyAs DNAas DNAas DNAts DNAas DNAgs DNAts DNAas DNAcs DNAts OxyGs OxyTs OxyTs OxyG |
| 397 | 102015 | 102033 | 103218 | 103236 | --- | --- | CTAGAAATGTA ACTTGTTG | ASO-0487 | OxyMCs OxyTs OxyAs OxyGs OxyAs DNAas DNAas DNAts DNAas DNAas DNAts DNAas DNAcs DNAts DNAts OxyGs OxyTs OxyTs OxyG |
| 398 | 102015 | 102034 | 103218 | 103237 | --- | --- | CCTAGAAATG TAACTTGTTG | ASO-0489 | OxyMCs OxyMCs DNAts DNAas DNAas DNAts DNAas DNAgs DNAts DNAas DNAcs DNAts DNAts DNAgs DNAts OxyTs OxyTs OxyG |
| 399 | 102016 | 102033 | 103219 | 103236 | --- | --- | CTAGAAATGTA ACTTGTT | ASO-0491 | OxyMCs OxyTs OxyAs OxyGs OxyAs DNAas DNAas DNAts DNAas DNAgs DNAts DNAas DNAcs DNAts DNAts OxyGs OxyTs OxyT |
| 400 | 102016 | 102034 | 103219 | 103237 | --- | --- | CCTAGAAATG TAACTTGTT | ASO-0493 | OxyMCs OxyMCs OxyTs OxyAs OxyGs OxyAs DNAas DNAas DNAts DNAas DNAas DNAcs DNAts DNAts DNAgs DNAts OxyTs OxyT |
| 401 | 102016 | 102035 | 103219 | 103238 | --- | --- | ACCTAGAAAT GTAACTTGTT | ASO-0495 | OxyAs OxyMCs OxyMCs OxyTs DNAas DNAas DNAgs DNAas DNAas DNAts DNAas DNAas DNAts DNAas DNAcs DNAts DNAts OxyGs OxyTs OxyT |
| 402 | 102017 | 102034 | 103220 | 103237 | --- | --- | CCTAGAAATG TAACTTGT | ASO-0497 | OxyMCs OxyMCs OxyTs DNAas DNAgs DNAas DNAas DNAts DNAas DNAcs DNAts OxyTs OxyGs OxyT |
| 403 | 102017 | 102035 | 103220 | 103238 | --- | --- | ACCTAGAAAT GTAACTTGT | ASO-0499 | OxyAs OxyMCs OxyMCs DNAts DNAas DNAgs DNAas DNAas DNAts DNAas DNAcs DNAts DNAas DNAts OxyGs OxyT |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 404 | 102017 | 102036 | 103220 | 103239 | -- | -- | CACCTAGAAA TGTAACTTGT | ASO-0501 | OxyMCs OxyAs DNAcs DNAcs DNAts DNAas DNAgs DNAas DNAas DNAas DNAas DNAts DNAgs DNAts DNAas DNAas DNAcs DNAts OxyGs OxyT |
| 405 | 102018 | 102035 | 103221 | 103238 | -- | -- | ACCTAGAAAT GTAACTTG | ASO-0503 | OxyAs OxyMCs OxyMCs OxyAs OxyTs DNAas DNAgs DNAas DNAas DNAas DNAts DNAgs DNAts DNAas DNAas OxyMCs OxyTs OxyTs OxyG |
| 406 | 102018 | 102036 | 103221 | 103239 | -- | -- | CACCTAGAAA TGTAACTTG | ASO-0505 | OxyMCs OxyAs OxyMCs OxyMCs DNAts DNAgs DNAas DNAas DNAas DNAas DNAts DNAgs DNAts DNAas DNAas DNAcs OxyTs OxyTs OxyG |
| 407 | 102018 | 102037 | 103221 | 103240 | -- | -- | ACACCTAGAA ATGTAACTTG | ASO-0507 | OxyMCs OxyAs OxyMCs OxyAs DNAcs DNAts DNAas DNAgs DNAas DNAas DNAas DNAts DNAgs DNAts DNAas DNAas DNAcs OxyTs OxyTs OxyG |
| 408 | 102019 | 102036 | 103222 | 103239 | -- | -- | CACCTAGAAA TGTAACTT | ASO-0509 | OxyMCs OxyAs OxyMCs OxyMCs DNAts DNAgs DNAas DNAas DNAas DNAas DNAts DNAgs DNAts DNAas DNAas OxyAs OxyMCs OxyTs OxyT |
| 409 | 102019 | 102037 | 103222 | 103240 | -- | -- | ACACCTAGAA ATGTAACTT | ASO-0511 | OxyAs OxyMCs OxyAs OxyMCs DNAcs DNAts DNAas DNAgs DNAas DNAas DNAas DNAts DNAgs DNAts DNAas DNAas OxyAs OxyMCs OxyTs OxyT |
| 410 | 102020 | 102036 | 103223 | 103239 | -- | -- | CACCTAGAAA TGTAACT | ASO-0513 | OxyMCs OxyAs OxyMCs OxyMCs DNAts DNAgs DNAas DNAas DNAas DNAas DNAts DNAgs DNAts OxyAs OxyAs OxyMCs OxyT |
| 411 | 102020 | 102037 | 103223 | 103240 | -- | -- | ACACCTAGAA ATGTAACT | ASO-0515 | OxyAs OxyMCs OxyMCs OxyAs OxyMCs DNAas DNAcs DNAts DNAas DNAgs DNAas DNAas DNAts DNAgs DNAts OxyAs OxyAs OxyMCs OxyT |
| 412 | 102024 | 102041 | 103227 | 103244 | -- | -- | CTATACACCTA GAAATGT | ASO-0517 | OxyMCs OxyTs OxyAs DNAts DNAas DNAcs DNAas DNAcs DNAcs DNAts DNAas DNAgs DNAas DNAas OxyAs OxyTs OxyGs OxyT |
| 413 | 102024 | 102042 | 103227 | 103245 | -- | -- | ACTATACACCT AGAAATGT | ASO-0519 | OxyAs OxyMCs OxyTs OxyAs DNAts DNAas DNAcs DNAas DNAcs DNAcs DNAts DNAas DNAgs DNAas DNAas OxyTs OxyGs OxyT |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 414 | 102024 | 102043 | 103227 | 103246 | --- | --- | TACTATACACC TAGAAATGT | ASO-0521 | OxyT OxyTs OxyAs OxyMCs DNAts DNAas DNAts DNAas DNAcs DNAgs DNAas DNAcs DNAas DNAts OxyGs OxyT |
| 415 | 102025 | 102043 | 103228 | 103246 | --- | --- | TACTATACACC TAGAAATG | ASO-0523 | OxyT OxyTs OxyAs OxyMCs OxyTs DNAas DNAts DNAas DNAcs DNAas DNAgs DNAas OxyAs OxyAs OxyTs OxyG |
| 416 | 102026 | 102043 | 103229 | 103246 | --- | --- | TACTATACACC TAGAAAT | ASO-0525 | OxyTs OxyAs OxyMCs OxyTs DNAas DNAcs DNAas DNAts DNAas DNAgs OxyAs DNAas OxyAs OxyAs OxyT |
| 417 | 102026 | 102044 | 103229 | 103247 | --- | --- | CTACTATACAC CTAGAAAT | ASO-0527 | OxyMCs OxyTs OxyAs OxyMCs DNAts DNAas DNAts DNAas DNAcs DNAas DNAts DNAas DNAgs OxyAs OxyAs OxyAs OxyT |
| 418 | 102026 | 102045 | 103229 | 103248 | --- | --- | CCTACTATACA CCTAGAAAT | ASO-0529 | OxyMCs OxyMCs DNAts DNAas DNAcs DNAas DNAts DNAas DNAcs DNAas DNAts DNAas DNAgs OxyAs OxyAs OxyT |
| 419 | 102027 | 102044 | 103230 | 103247 | --- | --- | CTACTATACAC CTAGAAA | ASO-0531 | OxyMCs OxyTs OxyAs OxyMCs DNAts DNAcs DNAas DNAts DNAas DNAcs DNAas DNAts DNAas DNAgs OxyAs OxyAs OxyA |
| 420 | 102027 | 102045 | 103230 | 103248 | --- | --- | CCTACTATACA CCTAGAAA | ASO-0533 | OxyMCs OxyMCs DNAts DNAas DNAts DNAcs DNAas DNAts DNAas DNAcs DNAas DNAts DNAas DNAgs OxyAs OxyA |
| 421 | 102027 | 102046 | 103230 | 103249 | --- | --- | TCCTACTATAC ACCTAGAAA | ASO-0535 | OxyTs OxyMCs OxyMCs DNAts DNAas DNAcs DNAas DNAts DNAcs DNAas DNAts DNAas DNAcs DNAas DNAts DNAas DNAgs OxyAs OxyA |
| 422 | 102028 | 102047 | 103231 | 103250 | --- | --- | TTCCTACTATA CACCTAGAAA | ASO-0537 | OxyTs OxyTs OxyMCs OxyMCs DNAts DNAcs DNAas DNAcs DNAas DNAts DNAcs DNAas DNAts DNAas DNAgs OxyAs OxyA |
| 423 | 102029 | 102046 | 103232 | 103249 | --- | --- | TCCTACTATAC | ASO- | OxyTs OxyMCs DNAcs DNAts DNAas DNAcs |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 424 | 102030 | 102047 | | | | | ACCTAGA | 0539 | DNAts DNAas DNAts DNAas DNAcs DNAas DNAcs DNAts DNAas OxyGs OxyA |
| 425 | 102031 | 102047 | 103233 | 103250 | | | TTCCTACTATA CACCTAG | ASO-0541 | OxyTs OxyTs OxyMCs DNAcs DNAts DNAas DNAcs DNAts DNAas DNAcs DNAts DNAas DNAcs DNAcs DNAts DNAas DNAcs OxyAs OxyG |
| 426 | 102031 | 102047 | 103234 | 103250 | | | TTCCTACTATA CACCTA | ASO-0543 | OxyTs OxyTs OxyMCs DNAcs DNAts DNAas DNAcs DNAts DNAas DNAcs DNAts DNAas DNAcs DNAcs DNAts OxyTs OxyA |
| 427 | 102033 | 102049 | 103236 | 103252 | | | TGTTCCTACTA CACC | ASO-0545 | OxyTs OxyGs DNAts DNAas DNAcs DNAts DNAas DNAcs DNAts DNAas DNAcs OxyAs OxyMCs OxyMC |
| 428 | 102033 | 102050 | 103236 | 103253 | | | TTGTTCCTACT ATACACC | ASO-0547 | OxyMCs DNAts DNAgs DNAts DNAas DNAcs DNAts DNAas DNAcs DNAts DNAas DNAcs OxyAs OxyMCs OxyMC |
| 429 | 102033 | 102051 | 103236 | 103254 | | | TTTGTTCCTAC TATACACC | ASO-0549 | OxyTs DNAts DNAgs DNAts DNAas DNAcs DNAts DNAas DNAcs DNAts DNAas DNAcs DNAts DNAaas OxyMCs OxyMC |
| 430 | 102034 | 102050 | 103237 | 103253 | | | TTGTTCCTACT ATACAC | ASO-0551 | OxyTs OxyTs OxyGs DNAts DNAcs DNAts DNAas DNAcs DNAts DNAas DNAcs DNAts OxyAs OxyMCs OxyMC |
| 431 | 102034 | 102051 | 103237 | 103254 | | | TTTGTTCCTAC TATACAC | ASO-0553 | OxyTs OxyTs OxyTs DNAgs DNAts DNAas DNAcs DNAts DNAas DNAcs DNAts OxyAs OxyMCs OxyAs OxyMC |
| 432 | 102034 | 102052 | 103237 | 103255 | | | TTTTGTTCCTA CTATACAC | ASO-0555 | OxyTs OxyTs OxyTs DNAts DNAgs DNAts DNAas DNAcs DNAts DNAas DNAcs DNAts OxyAs OxyMCs OxyAs OxyMC |
| 433 | 102034 | 102053 | 103237 | 103256 | | | GTTTTGTTCCT ACTATACAC | ASO-0557 | OxyGs OxyTs DNAts DNAts DNAcs DNAts DNAas DNAcs DNAts DNAas DNAcs DNAts DNAas DNAcs OxyAs OxyMC |
| 434 | 102035 | 102051 | 103238 | 103254 | | | TTTGTTCCTAC TATACA | ASO-0559 | OxyTs OxyTs OxyTs OxyGs DNAts DNAts DNAcs DNAts DNAas DNAcs DNAts DNAas DNAcs DNAts OxyMCs OxyA |
| 434 | 102035 | 102052 | 103238 | 103255 | | | TTTTGTTCCTA | ASO- | OxyTs OxyTs DNAts DNAts DNAgs DNAts |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 435 | 102035 | 102053 | 103238 | 103256 | --- | --- | CTATACA | 0561 | DNAts DNAcs DNAcs DNAts DNAas DNAcs DNAts DNAas OxyTs OxyAs OxyMCs OxyA |
| 512 | 131977 | 131994 | 135062 | 135079 | --- | --- | GTTTTGTTCCT ACTATACA | ASO-0563 | OxyGs OxyTs DNAts DNAts DNAts DNAgs DNAts DNAts DNAcs DNAcs DNAts DNAas DNAcs DNAts DNAas OxyMCs OxyA |
| 513 | 131977 | 131995 | 135062 | 135080 | --- | --- | TGGAGATTTA GGATATTG | ASO-0635 | OxyTs OxyGs OxyGs DNAas DNAgs DNAas DNAts DNAts DNAts DNAas DNAgs DNAgs DNAas DNAts OxyAs OxyTs OxyG |
| 514 | 131977 | 131996 | 135062 | 135081 | --- | --- | GTGGAGATTT AGGATATTG | ASO-0637 | OxyGs OxyTs OxyGs DNAas DNAgs DNAas DNAgs DNAts DNAts DNAts DNAas DNAgs DNAas DNAts OxyTs OxyT |
| 515 | 131978 | 131996 | 135063 | 135081 | --- | --- | AGTGGAGATT TAGGATATTG | ASO-0639 | OxyAs OxyGs OxyTs DNAgs DNAas DNAgs DNAas DNAgs DNAts DNAts DNAts DNAas DNAgs DNAas DNAts OxyTs OxyG |
| 516 | 131978 | 131997 | 135063 | 135082 | --- | --- | AGTGGAGATT TAGGATATT | ASO-0641 | OxyAs OxyGs OxyTs OxyGs DNAgs DNAas DNAgs DNAas DNAgs DNAts DNAts DNAts DNAas DNAgs DNAas DNAts OxyT |
| 517 | 131979 | 131997 | 135064 | 135082 | --- | --- | CAGTGGAGAT TTAGGATATT | ASO-0643 | OxyMCs OxyAs OxyGs OxyAs DNAts DNAgs DNAas DNAgs DNAas DNAgs DNAts DNAts DNAts DNAas DNAgs DNAas DNAts OxyAs OxyTs OxyT |
| 518 | 131979 | 131998 | 135064 | 135083 | --- | --- | CAGTGGAGAT TTAGGATAT | ASO-0645 | OxyMCs OxyAs DNAgs DNAas DNAgs DNAas DNAgs DNAts DNAts DNAts DNAas DNAgs DNAas DNAts OxyAs OxyT |
| 519 | 131980 | 131997 | 135065 | 135082 | --- | --- | TCAGTGGAGA TTTAGGATAT | ASO-0647 | OxyTs OxyMCs DNAas DNAgs DNAas DNAgs DNAas DNAgs DNAts DNAts DNAts DNAas DNAgs DNAas DNAts OxyAs OxyT |
| 520 | 131980 | 131998 | 135065 | 135083 | --- | --- | CAGTGGAGAT TTAGGATA | ASO-0649 | OxyMCs OxyAs OxyGs DNAas DNAgs DNAas DNAts DNAts DNAts DNAas DNAgs DNAas DNAts OxyTs OxyA |
| | | | | | | | TCAGTGGAGA | ASO- | OxyTs OxyMCs OxyAs DNAgs DNAts DNAgs |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 521 | 131981 | 131997 | 135066 | 135082 | --- | --- | CAGTGGAGAT TTAGGAT | ASO-0653 | OxyMCs OxyAs DNAgs DNAts DNAgs DNAgs DNAas DNAas DNAts DNAts DNAts DNAas OxyGs OxyAs OxyT |
| 522 | 131981 | 131998 | 135066 | 135083 | --- | --- | TCAGTGGAGA TTTAGGAT | ASO-0655 | OxyTs OxyMCs OxyAs OxyGs DNAts DNAgs DNAgs DNAas DNAas DNAts DNAts DNAgs OxyAs OxyT |
| 523 | 132017 | 132034 | 135100 | 135117 | --- | --- | TGTATAATTCA CAATGTT | ASO-0657 | OxyTs OxyGs OxyTs OxyAs DNAts DNAas DNAts DNAts DNAas DNAcs OxyGs OxyTs OxyT |
| 524 | 132017 | 132035 | 135100 | 135118 | --- | --- | ATGTATAATTC ACAATGTT | ASO-0659 | OxyAs OxyTs OxyGs OxyTs DNAas DNAts DNAts DNAas DNAts DNAas DNAcs OxyGs OxyTs OxyT |
| 525 | 132017 | 132036 | 135100 | 135119 | --- | --- | GATGTATAATT CACAATGTT | ASO-0661 | OxyGs OxyAs OxyTs OxyGs DNAts DNAas DNAts DNAas DNAts DNAas DNAcs OxyTs OxyT |
| 526 | 132018 | 132036 | 135101 | 135119 | --- | --- | GATGTATAATT CACAATGT | ASO-0663 | OxyGs OxyAs OxyTs OxyGs DNAts DNAas DNAts DNAas DNAts DNAas DNAcs OxyTs OxyT |
| 527 | 132019 | 132036 | 135102 | 135119 | --- | --- | GATGTATAATT CACAATG | ASO-0665 | OxyGs OxyAs OxyTs OxyGs DNAts DNAas DNAts DNAcs DNAas OxyAs OxyTs OxyG |
| 694 | 176158 | 176177 | 176250 | 176269 | 176267 | 176286 | TATAGTATAGA TTAGTATAT | ASO-0823 | OxyTs OxyAs OxyTs OxyAs DNAts DNAas DNAgs DNAts DNAts DNAas OxyAs OxyT |
| 695 | 176159 | 176178 | 176250 | 176269 | --- | --- | GTATAGTATAG ATTAGTATA | ASO-0826 | OxyGs OxyTs OxyAs OxyTs DNAas DNAts DNAts DNAas DNAgs DNAts OxyAs OxyTs OxyA |
| 696 | 176160 | 176178 | 176267 | 176286 | --- | --- | GTATAGTATAG ATTAGTAT | ASO-0828 | OxyGs OxyTs OxyAs OxyTs DNAas DNAgs DNAts DNAas DNAgs DNAas DNAgs DNAas |

FIG. 1B (cont.)

| SEQ ID No. | Start #1 (SEQ ID NO: 1) | End #1 (SEQ ID NO: 1) | Start #2 (SEQ ID NO: 1) | End #2 (SEQ ID NO: 1) | Start #3 (SEQ ID NO: 1) | End #3 (SEQ ID NO: 1) | ASO Sequence | ASO No. | ASO with Chemical Structure |
|---|---|---|---|---|---|---|---|---|---|
| 697 | 176160 | 176179 | 176268 | 176287 | --- | --- | AGTATAGTATAGATTAGTAT | ASO-0830 | DNAts DNAts DNAas DNAgs OxyTs OxyAs OxyT OxyAs OxyGs OxyTs DNAas DNAts DNAts DNAas DNAgs DNAts DNAts DNAas DNAgs OxyTs OxyAs OxyT |
| 698 | 176161 | 176178 | 176269 | 176287 | --- | --- | GTATAGTATAGATTAGTA | ASO-0832 | OxyAs OxyTs OxyAs DNAas DNAts DNAas DNAgs DNAts DNAts DNAas OxyGs OxyTs OxyA |
| 699 | 176161 | 176179 | 176269 | 176288 | --- | --- | AGTATAGTATAGATTAGTA | ASO-0834 | OxyAs OxyGs OxyTs DNAas DNAts DNAas DNAgs DNAts DNAts DNAas OxyAs OxyGs OxyTs OxyA |
| 700 | 176162 | 176178 | 176270 | 176287 | --- | --- | GTATAGTATAGATTAGT | ASO-0836 | OxyGs OxyTs OxyAs DNAas DNAts DNAas DNAgs DNAts DNAts DNAts OxyTs OxyAs OxyGs OxyT |
| 701 | 176162 | 176179 | 176270 | 176288 | --- | --- | AGTATAGTATAGATTAGT | ASO-0838 | OxyAs OxyGs OxyTs DNAas DNAts DNAas DNAgs DNAts DNAts DNAas OxyTs OxyAs OxyGs OxyT |
| 702 | 176163 | 176179 | 176271 | 176287 | --- | --- | AGTATAGTATAGATTAG | ASO-0840 | OxyAs OxyGs OxyTs OxyAs DNAas DNAts DNAas DNAgs DNAts DNAas OxyTs OxyAs OxyG |
| 996 | 221987 | 222003 | 235946 | 235962 | --- | --- | GATGATGAGTTTAAGGG | ASO-1111 | OxyGs OxyAs OxyTs DNAgs DNAas DNAts DNAgs DNAas DNAts DNAts OxyAs OxyGs OxyG |

FIG. 3

| SEQ ID No. | Start (SEQ ID NO: 1) | End (SEQ ID NO: 1) | DES No. | ASO with Design | ASO No. |
|---|---|---|---|---|---|
| 24 | 2566 | 2583 | DES-0002 | GAtaattttggcagCATA | ASO-0002 |
| 25 | 2566 | 2584 | DES-0003 | TGAtaattttggcagcATA | ASO-0003 |
| 27 | 2567 | 2584 | DES-0005 | TGAtaattttggcagCAT | ASO-0005 |
| 55 | 3576 | 3593 | DES-0135 | ATTTgcaataaataTGGA | ASO-0135 |
| 61 | 5256 | 5274 | DES-0141 | GATTtattttcagtaTTTG | ASO-0141 |
| 63 | 6204 | 6221 | DES-0143 | ACTTtatataatttGACA | ASO-0143 |
| 71 | 8068 | 8085 | DES-0150 | TTTCtttaaatcaaTACT | ASO-0150 |
| 75 | 9246 | 9263 | DES-0154 | TGTAtagtgagataTTTT | ASO-0154 |
| 79 | 10665 | 10684 | DES-0158 | GAAAttcaaattatccAGAA | ASO-0158 |
| 84 | 12135 | 12154 | DES-0162 | AGAAaatactgaattaTACA | ASO-0162 |
| 85 | 12329 | 12346 | DES-0163 | GTAGaatggatcaaAATT | ASO-0163 |
| 92 | 14390 | 14407 | DES-0170 | ATCTtagttttggaTTTG | ASO-0170 |
| 102 | 17218 | 17235 | DES-0179 | ACAGttttatagatAAGA | ASO-0179 |
| 105 | 17708 | 17725 | DES-0182 | AGTCattaattcttTATC | ASO-0182 |
| 114 | 21808 | 21826 | DES-0190 | TCCtttgtatttcttgAAT | ASO-0190 |
| 128 | 26381 | 26397 | DES-0203 | GAGAtcaataaagTATA | ASO-0203 |
| 130 | 28249 | 28265 | DES-0208 | AGATatagttactTAAC | ASO-0208 |
| 138 | 29430 | 29446 | DES-0212 | AATAttattggttGAGC | ASO-0212 |
| 158 | 35743 | 35762 | DES-0231 | TACatattatattactcCTC | ASO-0231 |

FIG. 3 (cont.)

| SEQ ID No. | Start (SEQ ID NO: 1) | End (SEQ ID NO: 1) | DES No. | ASO with Design | ASO No. |
|---|---|---|---|---|---|
| 161 | 37100 | 37119 | DES-0234 | ATTTagcacatacattTAAC | ASO-0234 |
| 178 | 41742 | 41758 | DES-0249 | CACAaatcattagTCTA | ASO-0249 |
| 180 | 42531 | 42548 | DES-0251 | TTCAtattatgctgTTTT | ASO-0251 |
| 186 | 44345 | 44361 | DES-0257 | AAAGtgagtgttaAGGT | ASO-0257 |
| 190 | 46568 | 46586 | DES-0261 | TGTttctaggtttcatTTT | ASO-0261 |
| 195 | 47770 | 47788 | DES-0265 | TAATttatcatgtatTCAG | ASO-0265 |
| 200 | 49272 | 49289 | DES-0270 | GAAAtctgtgaataCTTT | ASO-0270 |
| 202 | 50024 | 50041 | DES-0272 | CATTaaatatacttGTTC | ASO-0272 |
| 234 | 58780 | 58796 | DES-0304 | GTTGagaatacagATTG | ASO-0304 |
| 264 | 69068 | 69086 | DES-0332 | ATACattttacattaTTCT | ASO-0332 |
| 327 | 84562 | 84581 | DES-0409 | TTTgtttcaccattttaTAC | ASO-0409 |
| 387 | 102012 | 102030 | DES-0467 | GAAAtgtaacttgttGAGT | ASO-0467 |
| 390 | 102013 | 102030 | DES-0473 | GAAAtgtaacttgtTGAG | ASO-0473 |
| 396 | 102015 | 102032 | DES-0485 | TAGAaatgtaacttGTTG | ASO-0485 |
| 441 | 103690 | 103708 | DES-0570 | AAATcgttctttacaTGAA | ASO-0570 |
| 446 | 104608 | 104625 | DES-0574 | ATTAttatggtgttTTGT | ASO-0574 |
| 457 | 114694 | 114710 | DES-0583 | TAGAtttataaggATTG | ASO-0583 |
| 463 | 116502 | 116519 | DES-0589 | TTTatgaagtttctgTGG | ASO-0589 |
| 467 | 117904 | 117921 | DES-0593 | GTCTtatattacatCAAA | ASO-0593 |
| 513 | 131977 | 131995 | DES-0637 | GTGgagatttaggataTTG | ASO-0637 |

FIG. 3 (cont.)

| SEQ ID No. | Start (SEQ ID NO: 1) | End (SEQ ID NO: 1) | DES No. | ASO with Design | ASO No. |
|---|---|---|---|---|---|
| 516 | 131978 | 131997 | DES-0643 | CAGtggagatttaggatATT | ASO-0643 |
| 519 | 131980 | 131997 | DES-0649 | CAGtggagatttaggATA | ASO-0649 |
| 523 | 132017 | 132034 | DES-0657 | TGTAtaattcacaaTGTT | ASO-0657 |
| 524 | 132017 | 132035 | DES-0659 | ATGTataattcacaaTGTT | ASO-0659 |
| 636 | 157447 | 157465 | DES-0769 | TTTAttaatctcattTACT | ASO-0769 |
| 640 | 159834 | 159851 | DES-0773 | ACACtattttagttCTTT | ASO-0773 |
| 657 | 165142 | 165160 | DES-0788 | ATTtattgagtacaggCAG | ASO-0788 |
| 659 | 166220 | 166239 | DES-0790 | ATGgtctattaaatgtgCAA | ASO-0790 |
| 700 | 176162 | 176178 | DES-0836 | GTATagtatagatTAGT | ASO-0836 |
| 740 | 184958 | 184975 | DES-0874 | TTGTttagtattcaTTTC | ASO-0874 |
| 822 | 209852 | 209868 | DES-0951 | TGccactatgtcttCAA | ASO-0951 |
| 827 | 210416 | 210435 | DES-0956 | TTAgatattcattgttcAGT | ASO-0956 |
| 832 | 211327 | 211344 | DES-0960 | TTTTaatttcaaccAGTA | ASO-0960 |
| 965 | 216411 | 216429 | DES-1081 | TTTAactttactataTTGG | ASO-1081 |
| 981 | 220916 | 220933 | DES-1096 | CAAcaaccatttatAGCA | ASO-1096 |
| 982 | 220916 | 220934 | DES-1097 | TCaacaaccatttataGCA | ASO-1097 |
| 983 | 220917 | 220934 | DES-1098 | TCAAcaaccatttatAGC | ASO-1098 |
| 984 | 220917 | 220935 | DES-1099 | GTCaacaaccatttataGC | ASO-1099 |
| 986 | 220918 | 220935 | DES-1101 | GTCAacaaccatttaTAG | ASO-1101 |
| 989 | 220919 | 220936 | DES-1104 | TGTCaacaaccatttaTA | ASO-1104 |

FIG. 3 (cont.)

| SEQ ID No. | Start (SEQ ID NO: 1) | End (SEQ ID NO: 1) | DES No. | ASO with Design | ASO No. |
|---|---|---|---|---|---|
| 1015 | 223970 | 223987 | DES-1131 | TCAAtgtttccaaaCAAT | ASO-1131 |
| 1065 | 227969 | 227987 | DES-1179 | ATTAtctattatgttGTTT | ASO-1179 |
| 1071 | 229629 | 229646 | DES-1185 | TCTTttctattaccATTC | ASO-1185 |
| 1155 | 244274 | 244291 | DES-1266 | GTAGaatatagagaATGA | ASO-1266 |
| 1247 | 248053 | 248069 | DES-1357 | TCaagcagtctacaGTC | ASO-1357 |
| 1249 | 248054 | 248070 | DES-1359 | TTCaagcagtctacAGT | ASO-1359 |
| 1326 | 251988 | 252004 | DES-1435 | CAGttgtgtttattGGA | ASO-1435 |
| 1359 | 253080 | 253097 | DES-1468 | ATTAattaattcccAAGA | ASO-1468 |
| 1363 | 253647 | 253664 | DES-1472 | CtttctgaattgaCCAG | ASO-1472 |
| 1371 | 253676 | 253691 | DES-1480 | ATCAtctgaacacTCG | ASO-1480 |
| 1387 | 256887 | 256904 | DES-1495 | TttgttgtttatctGTGG | ASO-1495 |
| 1389 | 256888 | 256905 | DES-1497 | CtttgttgtttatcTGTG | ASO-1497 |
| 1390 | 256889 | 256906 | DES-1498 | GCtttgttgtttatctGT | ASO-1498 |
| 1409 | 258296 | 258315 | DES-1517 | TAAtcactataatttgaGGC | ASO-1517 |
| 1415 | 258714 | 258732 | DES-1523 | GCAAaagaccttattctTG | ASO-1523 |
| 1420 | 258716 | 258732 | DES-1528 | GCAAaagaccttatTCT | ASO-1528 |
| 1429 | 258966 | 258982 | DES-1537 | TCagggtgtggaTTAC | ASO-1537 |
| 1475 | 261720 | 261737 | DES-1582 | TCATtattagttgtCATT | ASO-1582 |
| 1508 | 277421 | 277440 | DES-1612 | ATTGtatttcttgattTTAC | ASO-1612 |
| 1524 | 282021 | 282039 | DES-1627 | GTTattattattttcaGGT | ASO-1627 |

FIG. 3 (cont.)

| SEQ ID No. | Start (SEQ ID NO: 1) | End (SEQ ID NO: 1) | DES No. | ASO with Design | ASO No. |
|---|---|---|---|---|---|
| 1530 | 283532 | 283549 | DES-1632 | TGTtagttttattctCAG | ASO-1632 |
| 1659 | 308035 | 308052 | DES-1756 | GatgtgaattttcCAGT | ASO-1756 |
| 1662 | 308896 | 308912 | DES-1759 | AGGactgtgaattaCTA | ASO-1759 |
| 1663 | 309052 | 309069 | DES-1760 | ATCagaaaagcttcAACC | ASO-1760 |
| 1676 | 309428 | 309444 | DES-1773 | TATatacagtgtccCAT | ASO-1773 |
| 1685 | 309482 | 309501 | DES-1782 | CACAaatttattaactCTTA | ASO-1782 |
| 1686 | 309483 | 309501 | DES-1783 | CACAaatttattaacTCTT | ASO-1783 |
| 1687 | 309483 | 309502 | DES-1784 | TCACaaatttattaacTCTT | ASO-1784 |
| 1688 | 309484 | 309501 | DES-1785 | CACAaatttattaaCTCT | ASO-1785 |
| 1690 | 309484 | 309503 | DES-1787 | ATCAcaaatttattaaCTCT | ASO-1787 |

FIG. 4

| ASO_NO | Single point, 25 µM, HEK293, mRNA, %UTC | Single point, 500 nM, human iPSC-CM, mRNA, %UTC |
|---|---|---|
| ASO-0003 | 12.99 | |
| ASO-0005 | 12.40 | |
| ASO-0190 | 17.39 | |
| ASO-0231 | 2.69 | 12.27 |
| ASO-0261 | 7.88 | 43.24 |
| ASO-0409 | 18.68 | |
| ASO-0589 | 17.40 | |
| ASO-0637 | 4.23 | 17.48 |
| ASO-0643 | 10.78 | |
| ASO-0649 | 8.04 | |
| ASO-0788 | 13.01 | |
| ASO-0790 | 11.02 | |
| ASO-0956 | 5.12 | 15.39 |
| ASO-1359 | 14.79 | 19.47 |
| ASO-1435 | 6.76 | 12.42 |
| ASO-1517 | 19.20 | |
| ASO-1627 | 10.31 | |
| ASO-1632 | 13.79 | |
| ASO-1759 | 12.88 | |
| ASO-1773 | 12.70 | |

FIG. 5

| ASO_NO | CAMK2D/GAPDH (% ctrl) |
|---|---|
| ASO-0002 | 82 |
| ASO-1104 | 56 |
| ASO-1099 | 87 |
| ASO-1096 | 69 |
| ASO-1101 | 65 |
| ASO-1097 | 77 |
| ASO-1098 | 77 |
| ASO-0951 | 75 |
| ASO-1528 | 81 |
| ASO-1756 | 76 |
| ASO-1784 | 70 |
| ASO-1472 | 83 |
| ASO-1787 | 69 |
| ASO-1760 | 71 |
| ASO-1783 | 59 |
| ASO-1782 | 74 |
| ASO-1497 | 70 |
| ASO-1498 | 67 |
| ASO-1785 | 66 |
| ASO-1523 | 73 |
| ASO-1468 | 70 |
| ASO-1357 | 88 |
| ASO-1537 | 78 |
| ASO-1495 | 70 |
| ASO-1480 | 70 |

CAMK2D ANTISENSE OLIGONUCLEOTIDES AND USES THEREOF

CROSS-REFERENCE TO RELATED APPLICATIONS

This application claims priority benefit of U.S. Provisional Application Nos. 62/633,502, filed Feb. 21, 2018; 62/635,954, filed Feb. 27, 2018; 62/665,998 filed May 2, 2018; and 62/778,679, filed Dec. 12, 2018, each of which is incorporated herein by reference in its entirety.

REFERENCE TO SEQUENCE LISTING SUBMITTED ELECTRONICALLY VIA EFS-WEB

The content of the electronically submitted sequence listing (Name: 3338_1020005_SequenceListing_ST25.txt, Size: 746,302 bytes; and Date of Creation: Feb. 20, 2019) submitted in this application is incorporated herein by reference in its entirety.

FIELD OF DISCLOSURE

The present disclosure relates to antisense oligomeric compounds (ASOs) that target calcium/calmodulin-dependent protein kinase type II delta (CAMK2D) transcript in a cell, leading to reduced expression of CAMK2D protein. Reduction of CAMK2D protein expression can be beneficial for a range of medical disorders, such as cardiovascular-related diseases or disorders.

BACKGROUND

Calcium/calmodulin ($Ca^{2+}$/CaM)-dependent serine/threonine kinases (CaMKs) constitute a family of 81 proteins in the human proteasome that play a central role in cellular signaling by transmitting $Ca^{2+}$ signals. Four CaMKII isozymes ($\alpha$, $\beta$, $\gamma$, and $\delta$), in addition to about 30 splice variants, are expressed in humans. Braun, A. P., et al., *Annual Review of Physiology* 57:417-445 (1995). Of these, CaMKIIδ ("CAMK2D") protein is the most abundant isoform in the heart and plays an important role in the excitation-contraction coupling (ECC) and relaxation processes of normal cardiac physiology. Mattiazzi A., et al., *Am J Physiol Heart Circ Physiol* 308:H1177-H1191 (2015). CAMK2D activity has also been described as being important in the recovery process after certain heart related injury (e.g., ischemia-reperfusion injury). Said M., et al., *Am J Physiol Heart Circ Physiol* 285:H1198-205 (2003).

Despite various scientific advancements, heart-related diseases remain the leading cause of death for both men and women worldwide. The American Heart Association estimates that by 2030, nearly 40% of the U.S. population would have some form of a cardiovascular disease and the direct medical costs are projected to reach $818 billion. See Benjamin, E. J., et al., *Circulation* 135:e146-e603 (2017). However, Mattiazzi et al. notes that "[t]he ubiquitous nature of CaMKII and its effects on different protein targets challenge the use of CaMKII inhibitors as a therapeutic tool." *Am J Physiol Heart Circ Physiol* 308:H1177-H1191 (2015). Therefore, new treatment options that are much more robust and cost-effective are highly desirable.

SUMMARY OF DISCLOSURE

The present disclosure is directed to an antisense oligonucleotide (ASO) comprising, consisting essentially of, or consisting of the contiguous nucleotide sequence of 10 to 30 nucleotides in length that is complementary, such as fully complementary, to a nucleic acid sequence within a calcium/calmodulin-dependent protein kinase type II delta (CAMK2D) transcript. In some embodiments, the ASO of the present disclosure, or contiguous nucleotide sequence thereof, is at least about 80%, at least about 85%, at least about 90%, at least about 95%, or about 100% complementary to the nucleic acid sequence within the CAMK2D transcript. In some embodiments, the CAMK2D transcript is selected from the group consisting of SEQ ID NO: 1 and SEQ ID NO: 2.

In some embodiments, the ASO described herein is capable of reducing CAMK2D protein expression in a human cell (e.g., HEK293 cell) which is expressing the CAMK2D protein. In some embodiments, the CAMK2D protein expression is reduced by at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100% compared to CAMK2D protein expression in a human cell that is not exposed to the ASO.

In some embodiments, the ASO is capable of reducing CAMK2D transcript (e.g., mRNA) expression in a human cell (e.g., HEK293 cell), which is expressing the CAMK2D transcript. In some embodiments, the CAMK2D transcript expression is reduced by at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100% compared to CAMK2D transcript expression in a human cell that is not exposed to the ASO.

In some embodiments, the ASO disclosed herein is a gapmer. In some embodiments, the ASO has a design of $LLLD_nLLL$, $LLLLD_nLLLL$, or $LLLLLD_nLLLLL$, wherein the L is a nucleoside analog, the D is DNA, and n can be any integer between 4 and 24. In some embodiments, n can be any integer between 6 and 14. In some embodiments, n can be any integer between 8 and 12.

In some embodiments, the nucleoside analog of the ASO disclosed herein comprises a 2'-O-alkyl-RNA; 2'-O-methyl RNA (2'-OMe); 2'-alkoxy-RNA; 2'-O-methoxyethyl-RNA (2'-MOE); 2'-amino-DNA; 2'-fluro-RNA; 2'-fluoro-DNA; arabino nucleic acid (ANA); 2'-fluoro-ANA; or bicyclic nucleoside analog (LNA). In some embodiments, one or more of the nucleoside analog of the ASO is a sugar modified nucleoside. In some embodiments, the sugar modified nucleoside is an affinity enhancing 2' sugar modified nucleoside. In some embodiments, one or more of the nucleoside analog comprises a nucleoside comprising a bicyclic sugar. In some embodiments, the affinity enhancing 2' sugar modified nucleoside is an LNA. In some embodiments, the LNA is selected from the group consisting of constrained ethyl nucleoside (cEt), 2',4'-constrained 2'-O-methoxyethyl (cMOE), α-L-LNA, β-D-LNA, 2'-O,4'-C-ethylene-bridged nucleic acids (ENA), amino-LNA, oxy-LNA, thio-LNA, or any combination thereof. In some embodiments, the ASO comprises one or more 5'-methyl-cytosine nucleobases.

In some embodiments, the ASO described herein is capable of (i) reducing an mRNA level encoding CAMK2D in human Inducible Pluripotent Stem Cell-Derived Cardiomyocytes (hiPSC-CM); (ii) reducing a protein level of CAMK2D in hiPSC-CM; (iii) reducing, ameliorating, or treating one or more symptoms of a cardiovascular disease or disorder, and (iv) any combination thereof.

In some embodiments, the contiguous nucleotide sequence of the ASO is complementary to a nucleic acid sequence comprising (i) nucleotides 625-842 of SEQ ID NO: 1; (ii) nucleotides 1,398-59,755 of SEQ ID NO: 1; (iii) nucleotides 61,817-104,725 of SEQ ID NO: 1; (iv) nucleotides 112,162-118,021 of SEQ ID NO: 1; (v) nucleotides 119,440-135,219 of SEQ ID NO: 1; (vi) nucleotides 137,587-157,856 of SEQ ID NO: 1; (vii) nucleotides 159,191-266,174 of SEQ ID NO: 1; or (viii) nucleotides 272,788-310,949 of SEQ ID NO: 1. In some embodiments, the contiguous nucleotide sequence of the ASO is complementary to a nucleic acid sequence comprising (i) nucleotides 675-792 of SEQ ID NO: 1; (ii) nucleotides 1,448-59,705 of SEQ ID NO: 1; (iii) nucleotides 61,867-104,675 of SEQ ID NO: 1; (iv) nucleotides 112,212-117,971 of SEQ ID NO: 1; (v) nucleotides 119,490-135,169 of SEQ ID NO: 1; (vi) nucleotides 137,637-157,806 of SEQ ID NO: 1; (vii) nucleotides 159,241-266,124 of SEQ ID NO: 1; or (viii) nucleotides 272,838-310,899 of SEQ ID NO: 1. In some embodiments, the contiguous nucleotide sequence of the ASO is complementary to a nucleic acid sequence comprising (i) nucleotides 725-742 of SEQ ID NO: 1; (ii) nucleotides 1,498-59,655 of SEQ ID NO: 1; (iii) nucleotides 61,917-104,625 of SEQ ID NO: 1; (iv) nucleotides 112,262-117,921 of SEQ ID NO: 1; (v) nucleotides 119,540-135,119 of SEQ ID NO: 1; (vi) nucleotides 137,687-157,756 of SEQ ID NO: 1; (vii) 159,291-266,074 of SEQ ID NO: 1; or (viii) nucleotides 272,888-310,849 of SEQ ID NO: 1.

In some embodiments, the contiguous nucleotide sequence of the ASO comprises SEQ ID NO: 4 to SEQ ID NO: 1713 with one or two mismatches. In some embodiments, the contiguous nucleotide sequence of the ASO comprises the nucleotide sequence selected from the sequences in FIGS. 1A and 1B (SEQ ID NO: 4 to SEQ ID NO: 1713). In some embodiments, the contiguous nucleotide sequence of the ASO comprises SEQ ID NO: 25, SEQ ID NO: 27, SEQ ID NO: 114, SEQ ID NO: 158, SEQ ID NO: 190, SEQ ID NO: 327, SEQ ID NO: 463, SEQ ID NO: 513, SEQ ID NO: 516, SEQ ID NO: 519, SEQ ID NO: 657, SEQ ID NO: 659, SEQ ID NO: 827, SEQ ID NO: 1249, SEQ ID NO: 1326, SEQ ID NO: 1409, SEQ ID NO: 1524, SEQ ID NO: 1530, SEQ ID NO: 1662, or SEQ ID NO: 1676. In some embodiments, the contiguous nucleotide sequence of the ASO comprises SEQ ID NO: 55, SEQ ID NO: 61, SEQ ID NO: 63, SEQ ID NO: 71, SEQ ID NO: 75, SEQ ID NO: 79, SEQ ID NO: 84, SEQ ID NO: 85, SEQ ID NO: 92, SEQ ID NO: 102, SEQ ID NO: 105, SEQ ID NO: 128, SEQ ID NO: 130, SEQ ID NO: 133, SEQ ID NO: 138, SEQ ID NO: 161, SEQ ID NO: 178, SEQ ID NO: 180, SEQ ID NO: 186, SEQ ID NO: 195, SEQ ID NO: 200, SEQ ID NO: 202, SEQ ID NO: 234, SEQ ID NO: 264, SEQ ID NO: 387, SEQ ID NO: 390, SEQ ID NO: 396, SEQ ID NO: 441, SEQ ID NO: 446, SEQ ID NO: 457, SEQ ID NO: 467, SEQ ID NO: 523, SEQ ID NO: 524, SEQ ID NO: 636, SEQ ID NO: 640, SEQ ID NO: 700, SEQ ID NO: 740, SEQ ID NO: 832, SEQ ID NO: 965, SEQ ID NO: 1015, SEQ ID NO: 1065, SEQ ID NO: 1071, SEQ ID NO: 1155, SEQ ID NO: 1475, SEQ ID NO: 1508, SEQ ID NO: 1685, SEQ ID NO: 1686, SEQ ID NO: 1687, SEQ ID NO: 1688, or SEQ ID NO: 1690.

In some embodiments, the ASO of the present disclosure has a design selected from the group consisting of the designs in FIG. 3, wherein the upper letter is a sugar modified nucleoside and the lower case letter is DNA.

In some embodiments, the ASO disclosed herein is capable of reducing expression of CAMK2D protein in a hiPSC-CM cell which is expressing the CAMK2D protein. In some embodiments, the expression of CAMK2D protein is reduced by at least about 20%, at least about 30%, at least about 40%, at least about 50%, at least about 60%, at least about 70%, at least about 80%, at least about 90%, or about 100% compared to a cell not exposed to the ASO. In some embodiments, the ASO is capable of reducing expression of CAMK2D transcript (e.g., mRNA) in a hiPSC-CM cell which is expressing the CAMK2D transcript. In some embodiments, the expression of CAMK2D transcript is reduced by at least about 20%, at least about 30%, at least about 40%, at least about 50%, at least about 60%, at least about 70%, at least about 80%, at least about 90%, or about 100% compared to a cell not exposed to the ASO.

In some embodiments, the ASO has from 14 to 20 nucleotides in length. In some embodiments, the nucleotide sequence of the ASO comprises one or more modified internucleoside linkage. In some embodiments, at least 75%, at least 80%, at least 85%, at least 90%, at least 95%, or 100% of internucleoside linkages are modified. In certain embodiments, each of the internucleotide linkages in the ASO of the present disclosure is a phosphorothioate linkage.

The present disclosure also provides a conjugate comprising the ASO as disclosed herein, wherein the ASO is covalently attached to at least one non-nucleotide or non-polynucleotide moiety. In some embodiments, the non-nucleotide or non-polynucleotide moiety comprises a protein, a fatty acid chain, a sugar residue, a glycoprotein, a polymer, or any combinations thereof.

Also provided herein is a pharmaceutical composition comprising the ASO or the conjugate as disclosed herein and a pharmaceutically acceptable diluent, carrier, salt, or adjuvant. In certain embodiments, a pharmaceutically acceptable salt comprises a sodium salt, a potassium salt, or an ammonium salt. In some embodiments, the pharmaceutical composition further comprises at least one further therapeutic agent. In some embodiments, the further therapeutic agent is a CAMK2D antagonist. In some embodiments, the CAMK2D antagonist is an anti-CAMK2d antibody or fragment thereof.

The present disclosure further provides a kit comprising the ASO, the conjugate, or the pharmaceutical composition as disclosed herein, and instructions for use. Also disclosed is a diagnostic kit comprising the ASO, the conjugate, or the pharmaceutical composition of the present disclosure, and instructions for use.

The present disclosure is also directed method of inhibiting or reducing CAMK2D protein expression in a cell, comprising administering the ASO, the conjugate, or the pharmaceutical composition disclosed herein to the cell expressing CAMK2D protein, wherein the CAMK2D protein expression in the cell is inhibited or reduced after the administration. In some aspect, the present disclosure is directed to an in vitro method of inhibiting or reducing CAMK2D protein expression in a cell, comprising contacting the ASO, the conjugate, or the pharmaceutical composition disclosed herein to the cell expressing CAMK2D protein, wherein the CAMK2D protein expression in the cell is inhibited or reduced after the contacting. In some embodiments, the ASO inhibits or reduces expression of CAMK2D transcript (e.g., mRNA) in the cell after the administration. In some embodiments, the expression of CAMK2D transcript (e.g., mRNA) is reduced by at least about 20%, at least about 30%, at least about 40%, at least about 50%, at least about 60%, at least about 70%, at least about 80%, at least about 90%, or about 100% after the administration compared to a cell not exposed to the ASO. In some embodiments, the expression of CAMK2D protein is reduced by at least about 60%, at least about 70%, at least about 75%, at least about 80%, at least about 85%, at least about 90%, at least about 95%, at least about 96%, at least about 97%, at least about 98%, at least about 99%, or about 100% after the administration compared to a cell not exposed to the ASO. In some embodiments, the cell is a cardiac cell, e.g., hiPSC-CM.

Provided herein is a method of reducing, ameliorating, or treating one or more symptoms of a cardiovascular disease or disorder in a subject in need thereof, comprising administering an effective amount of the ASO, the conjugate, or the pharmaceutical composition of the present disclosure to the subject. The present disclosure also provides the use of the ASO, the conjugate, or the pharmaceutical composition disclosed herein for the manufacture of a medicament. In some embodiments, the medicament is for the treatment of a cardiovascular disease or disorder in a subject in need thereof. In some embodiments, the ASO, the conjugate, or the pharmaceutical composition of the present disclosure is for use in therapy. In some embodiments, the ASO, the conjugate, or the pharmaceutical composition disclosed herein is for use in therapy of a cardiovascular disease or disorder in a subject in need thereof.

In some embodiments, the cardiovascular disease or disorder comprises a coronary artery disease, stroke, heart failure, hypertensive heart disease, rheumatic heart disease, cardiomyopathy, heart arrhythmia, congenital heart disease, valvular heart disease carditis, aortic aneurysms, peripheral artery disease, thromboembolic disease, venous thrombosis, or any combination thereof. In some embodiments, the cardiovascular disease or disorder is a heart failure. In some embodiments, the heart failure comprises a left-sided heart failure, a right-sided heart failure, a congestive heart failure, a heart failure with reduced ejection fraction (HFrEF), a heart failure with preserved ejection fraction (HFpEF), a heart failure with mid-range ejection fraction (HFmrEF), a hypertrophic cardiomyopathy (HCM), a hypertensive heart disease (HHD), or hypertensive hypertrophic cardiomyopathy.

In some embodiments, the subject is a human. In some embodiments, the ASO, the conjugate, or the pharmaceutical composition of the present disclosure is administered intracardially, orally, parenterally, intrathecally, intra-cerebroventricularly, pulmorarily, topically, or intraventricularly.

BRIEF DESCRIPTION OF FIGURES

FIGS. 1A and 1B show exemplary ASOs targeting the CAMK2D pre-mRNA. FIG. 1A shows the ASOs targeting a single site within the CAMK2D pre-mRNA. FIG. 1B shows the ASOs targeting multiple sites (i.e., two or three) within the CAMK2D pre-mRNA. Each column of FIGS. 1A and 1B show the SEQ ID number designated for the sequence only of the ASO, the target start and end positions on the CAMK2D pre-mRNA sequence (for FIG. 1B, the multiple target sites are identified as #1, #2, or #3), the ASO sequence without any particular design or chemical structure, the ASO number (ASO No.), and the ASO sequence with a chemical structure.

FIG. 3 shows certain exemplary ASOs with their design. Each column of FIG. 3 shows the SEQ ID NO for the ASO sequence only, the target start and end positions on the CAMK2D pre-mRNA sequence (where the ASO binds to multiple sites (see FIG. 1B), exemplary target start and end positions are provided), the ASO design number (DES No.), the ASO sequence with a design, and the ASO number (ASO No.).

FIG. 4 shows the percent reduction of CAMK2D mRNA expression in both HEK293 cells and human inducible pluripotent stem cell-derived cardiomyocytes (hiPSC-CM) after in vitro culture with various ASOs as described in Examples 2 and 3. The cells were treated with 25 µM (HEK293) or 500 nM (hiPSC-CM) of ASO and the CAMK2D mRNA expression (normalized to GAPDH) is shown as a percent of the control. Where no value is provided, the particular ASO was not tested under the particular conditions.

FIG. 5 shows the potency of exemplary ASOs on CAMK2D mRNA expression level in C57BL/6JBom mice one week after subcutaneous administration. CAMK2D mRNA expression level was normalized to GAPDH and then shown relative to the control group (i.e., saline treated samples).

DETAILED DESCRIPTION OF DISCLOSURE

I. Definitions

Figure 2:
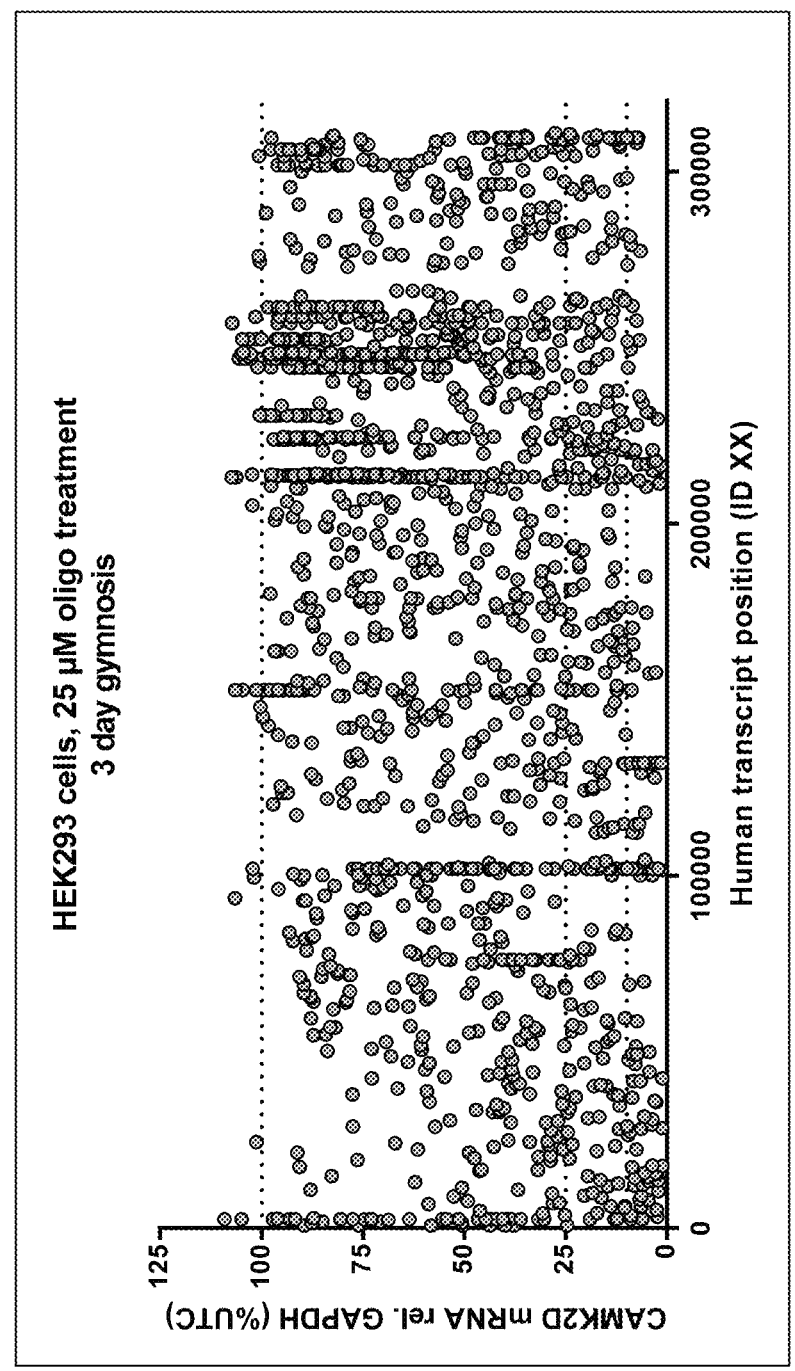
FIG. 2 shows both the percent reduction of CAMK2D mRNA expression in HEK293 cells (y-axis) and the relative position of the ASOs on the CAMK2D transcript (x-axis). Each circle represents an individual ASO. As further described in Example 2, the HEK293 cells were treated with 25 µM of ASO and the CAMK2D mRNA expression (normalized to GAPDH) is shown as a percent of the control.

It is to be noted that the term "a" or "an" entity refers to one or more of that entity; for example, "a nucleotide sequence," is understood to represent one or more nucleotide sequences. As such, the terms "a" (or "an"), "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

It is understood that wherever aspects are described herein with the language "comprising," otherwise analogous aspects described in terms of "consisting of" and/or "consisting essentially of" are also provided.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Système International de Unites (SI) accepted form. Numeric ranges are inclusive of the numbers defining the range. Unless otherwise indicated, nucleotide sequences are written left to right in 5' to 3' orientation. Amino acid sequences are written left to right in amino to carboxy orientation. The headings provided herein are not limitations of the various aspects of the disclosure, which can be had by reference to the specification as a whole. Accordingly, the terms defined immediately below are more fully defined by reference to the specification in its entirety.

The term "about" is used herein to mean approximately, roughly, around, or in the regions of When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower). For example, if it is stated that "the ASO reduces expression of CAMK2d protein in a cell following administration of the ASO by at least about 60%," it is implied that the CAMK2D levels are reduced by a range of 50% to 70%.

The term "nucleic acids" or "nucleotides" is intended to encompass plural nucleic acids. In some embodiments, the term "nucleic acids" or "nucleotides" refers to a target sequence, e.g., pre-mRNAs, mRNAs, or DNAs in vivo or in vitro. When the term refers to the nucleic acids or nucleotides in a target sequence, the nucleic acids or nucleotides can be naturally occurring sequences within a cell. In other embodiments, "nucleic acids" or "nucleotides" refer to a sequence in the ASOs of the disclosure. When the term refers to a sequence in the ASOs, the nucleic acids or nucleotides are not naturally occurring, i.e., chemically synthesized, enzymatically produced, recombinantly produced, or any combination thereof. In one embodiment, the nucleic acids or nucleotides in the ASOs are produced synthetically or recombinantly, but are not a naturally occurring sequence or a fragment thereof. In another embodiment, the nucleic acids or nucleotides in the ASOs are not naturally occurring because they contain at least one nucleotide analog that is not naturally occurring in nature. The term "nucleic acid" or "nucleoside" refers to a single nucleic acid segment, e.g., a DNA, an RNA, or an analog thereof, present in a polynucleotide. "Nucleic acid" or "nucleoside" includes naturally occurring nucleic acids or non-naturally occurring nucleic acids. In some embodiments, the terms "nucleotide", "unit" and "monomer" are used interchangeably. It will be recognized that when referring to a sequence of nucleotides or monomers, what is referred to is the sequence of bases, such as A, T, G, C or U, and analogs thereof.

The term "nucleotide" as used herein, refers to a glycoside comprising a sugar moiety, a base moiety and a covalently linked group (linkage group), such as a phosphate or phosphorothioate internucleotide linkage group, and covers both naturally occurring nucleotides, such as DNA or RNA, and non-naturally occurring nucleotides comprising modified sugar and/or base moieties, which are also referred to as "nucleotide analogs" herein. Herein, a single nucleotide (unit) can also be referred to as a monomer or nucleic acid unit. In certain embodiments, the term "nucleotide analogs" refers to nucleotides having modified sugar moieties. Non-limiting examples of the nucleotides having modified sugar moieties (e.g., LNA) are disclosed elsewhere herein. In other embodiments, the term "nucleotide analogs" refers to nucleotides having modified nucleobase moieties. The nucleotides having modified nucleobase moieties include, but are not limited to, 5-methyl-cytosine, isocytosine, pseudoisocytosine, 5-bromouracil, 5-propynyluracil, 6-aminopurine, 2-aminopurine, inosine, diaminopurine, and 2-chloro-6-aminopurine.

The term "nucleoside" as used herein is used to refer to a glycoside comprising a sugar moiety and a base moiety, and can therefore be used when referring to the nucleotide units, which are covalently linked by the internucleotide linkages between the nucleotides of the ASO. In the field of biotechnology, the term "nucleotide" is often used to refer to a nucleic acid monomer or unit. In the context of an ASO, the term "nucleotide" can refer to the base alone, i.e., a nucleobase sequence comprising cytosine (DNA and RNA), guanine (DNA and RNA), adenine (DNA and RNA), thymine (DNA) and uracil (RNA), in which the presence of the sugar backbone and internucleotide linkages are implicit. Likewise, particularly in the case of oligonucleotides where one or more of the internucleotide linkage groups are modified, the term "nucleotide" can refer to a "nucleoside." For example the term "nucleotide" can be used, even when specifying the presence or nature of the linkages between the nucleosides.

The term "nucleotide length" as used herein means the total number of the nucleotides (monomers) in a given sequence. For example, the sequence of tacatattatattactcctc (SEQ ID NO: 158) has 20 nucleotides; thus the nucleotide length of the sequence is 20. The term "nucleotide length" is therefore used herein interchangeably with "nucleotide number."

As one of ordinary skill in the art would recognize, the 5' terminal nucleotide of an oligonucleotide does not comprise a 5' internucleotide linkage group, although it can comprise a 5' terminal group.

As used herein, the term "alkyl", alone or in combination, signifies a straight-chain or branched-chain alkyl group with 1 to 8 carbon atoms, particularly a straight or branched-chain alkyl group with 1 to 6 carbon atoms and more particularly a straight or branched-chain alkyl group with 1 to 4 carbon atoms. Examples of straight-chain and branched-chain $C_1$-$C_8$ alkyl groups are methyl, ethyl, propyl, isopropyl, butyl, isobutyl, tert-butyl, the isomeric pentyls, the isomeric hexyls, the isomeric heptyls and the isomeric octyls, particularly methyl, ethyl, propyl, butyl and pentyl. Particular examples of alkyl are methyl. Further examples of alkyl are mono, di or trifluoro methyl, ethyl or propyl, such as cyclopropyl (cPr), or mono, di or tri fluoro cycloproyl.

The term "alkoxy", alone or in combination, signifies a group of the formula alkyl-O— in which the term "alkyl" has the previously given significance, such as methoxy, ethoxy, n-propoxy, isopropoxy, n-butoxy, isobutoxy, sec.butoxy and tert.butoxy. Particular "alkoxy" are methoxy.

The term "oxy", alone or in combination, signifies the —O— group.

The term "alkenyl", alone or in combination, signifies a straight-chain or branched hydrocarbon residue comprising an olefinic bond and up to 8, preferably up to 6, particularly preferred up to 4 carbon atoms. Examples of alkenyl groups are ethenyl, 1-propenyl, 2-propenyl, isopropenyl, 1-butenyl, 2-butenyl, 3-butenyl and isobutenyl.

The term "alkynyl", alone or in combination, signifies a straight-chain or branched hydrocarbon residue comprising a triple bond and up to 8, preferably up to 6, particularly preferred up to 4 carbon atoms.

The terms ""halogen"" or ""halo"", alone or in combination, signifies fluorine, chlorine, bromine or iodine and particularly fluorine, chlorine or bromine, more particularly fluorine and chlorine, such as fluorine. The term "halo", in combination with another group, denotes the substitution of said group with at least one halogen, particularly substituted with one to five halogens, particularly one to four halogens, i.e., one, two, three or four halogens. The terms "hydroxyl" and "hydroxy", alone or in combination, signify the —OH group.

The terms "thiohydroxyl" and "thiohydroxy", alone or in combination, signify the —SH group.

The term "carbonyl", alone or in combination, signifies the —C(O)— group.

The term "carboxy" or "carboxyl", alone or in combination, signifies the —COOH group.

The term "amino", alone or in combination, signifies the primary amino group (—NH2), the secondary amino group (—NH—), or the tertiary amino group (—N—).

The term "alkylamino", alone or in combination, signifies an amino group as defined above substituted with one or two alkyl groups as defined above.

The term "aminocarbonyl, alone or in combination, signifies the —C(O)—NH2 group.

The term "sulfonyl", alone or in combination, means the —SO2 group.

The term "sulfinyl", alone or in combination, signifies the —SO— group.

The term "sulfanyl", alone or in combination, signifies the —S— group.

The term "cyano", alone or in combination, signifies the —CN group.

The term "azido", alone or in combination, signifies the —N3 group.

The term "nitro", alone or in combination, signifies the NO2 group.

The term "formyl" alone or in combination, signifies the —C(O)H group.

The term "aryl", alone or in combination, denotes a monovalent aromatic carbocyclic mono- or bicyclic ring system comprising 6 to 10 carbon ring atoms, optionally substituted with 1 to 3 substituents independently selected from halogen, hydroxyl, alkyl, alkenyl, alkynyl, alkoxy, alkoxyalkyl, alkenyloxy, carboxyl, alkoxycarbonyl, alkylcarbonyl and formyl. Examples of aryl include phenyl and naphthyl. in particular phenyl.

The term "heteroaryl", alone or in combination, denotes a monovalent aromatic heterocyclic mono- or bicyclic ring system of 5 to 12 ring atoms, comprising 1, 2, 3 or 4 heteroatoms selected from N, O and S, the remaining ring atoms being carbon, optionally substituted with 1 to 3 substituents independently selected from halogen, hydroxyl, alkyl, alkenyl, alkynyl, alkoxy, alkoxyalkyl, alkenyloxy, carboxyl, alkoxycarbonyl, alkylcarbonyl and formyl. Examples of heteroaryl include pyrrolyl, furanyl, thienyl, imidazolyl, oxazolyl, thiazolyl, triazolyl, oxadiazolyl, thiadiazolyl, tetrazolyl, pyridinyl, pyrazinyl, pyrazolyl, pyridazinyl, pyrimidinyl, triazinyl, azepinyl, diazepinyl, isoxazolyl, benzofuranyl, isothiazolyl, benzothienyl, indolyl, isoindolyl, isobenzofuranyl, benzimidazolyl, benzoxazolyl, benzoisoxazolyl, benzothiazolyl, benzoisothiazolyl, benzooxadiazolyl, benzothiadiazolyl, benzotriazolyl, purinyl, quinolinyl, isoquinolinyl, quinazolinyl, quinoxalinyl, carbazolyl, or acridinyl.

The term "heterocycle", alone or in combination, denotes a monovalent non-aromatic heterocyclic mono- or bicyclic ring system of 5 to 12 ring atoms, comprising 1, 2, 3 or 4 heteroatoms selected from N, O and S, the remaining ring atoms being carbon, optionally substituted with 1 to 3 substituents independently selected from halogen, hydroxyl, alkyl, alkenyl, alkynyl, alkoxy, alkoxyalkyl, alkenyloxy, carboxyl, alkoxycarbonyl, alkylcarbonyl and formyl.

The term "protecting group", alone or in combination, signifies a group which selectively blocks a reactive site in a multifunctional compound such that a chemical reaction can be carried out selectively at another unprotected reactive site. Protecting groups can be removed. Exemplary protecting groups are amino-protecting groups, carboxy-protecting groups or hydroxy-protecting groups.

If one of the starting materials or compounds of the invention contain one or more functional groups which are not stable or are reactive under the reaction conditions of one or more reaction steps, appropriate protecting groups (as described e.g., in "Protective Groups in Organic Chemistry" by T. W. Greene and P. G. M. Wuts, 3rd Ed., 1999, Wiley, New York) can be introduced before the critical step applying methods well known in the art. Such protecting groups can be removed at a later stage of the synthesis using standard methods described in the literature. Examples of protecting groups are tert-butoxycarbonyl (Boc), 9-fluorenylmethyl carbamate (Fmoc), 2-trimethylsilylethyl carbamate (Teoc), carbobenzyloxy (Cbz) and p-methoxybenzyloxycarbonyl (Moz).

The compounds described herein can contain several asymmetric centers and can be present in the form of optically pure enantiomers, mixtures of enantiomers such as, for example, racemates, mixtures of diastereoisomers, diastereoisomeric racemates or mixtures of diastereoisomeric racemates.

The term "asymmetric carbon atom" means a carbon atom with four different substituents.

According to the Cahn-Ingold-Prelog Convention an asymmetric carbon atom can be of the "R" or "S" configuration.

As used herein, the term "bicyclic sugar" refers to a modified sugar moiety comprising a 4 to 7 membered ring comprising a bridge connecting two atoms of the 4 to 7 membered ring to form a second ring, resulting in a bicyclic structure. In some embodiments, the bridge connects the C2' and C4' of the ribose sugar ring of a nucleoside (i.e., 2'-4' bridge), as observed in LNA nucleosides.

As used herein, a "coding region" or "coding sequence" is a portion of polynucleotide which consists of codons translatable into amino acids. Although a "stop codon" (TAG, TGA, or TAA) is typically not translated into an amino acid, it can be considered to be part of a coding region, but any flanking sequences, for example promoters, ribosome binding sites, transcriptional terminators, introns, untranslated regions ("UTRs"), and the like, are not part of a coding region. The boundaries of a coding region are typically determined by a start codon at the 5' terminus, encoding the amino terminus of the resultant polypeptide, and a translation stop codon at the 3' terminus, encoding the carboxyl terminus of the resulting polypeptide.

The term "non-coding region" as used herein means a nucleotide sequence that is not a coding region. Examples of non-coding regions include, but are not limited to, promoters, ribosome binding sites, transcriptional terminators, introns, untranslated regions ("UTRs"), non-coding exons and the like. Some of the exons can be wholly or part of the 5' untranslated region (5' UTR) or the 3' untranslated region (3' UTR) of each transcript. The untranslated regions are important for efficient translation of the transcript and for controlling the rate of translation and half-life of the transcript.

The term "region" when used in the context of a nucleotide sequence refers to a section of that sequence. For example, the phrase "region within a nucleotide sequence" or "region within the complement of a nucleotide sequence" refers to a sequence shorter than the nucleotide sequence, but longer than at least 10 nucleotides located within the particular nucleotide sequence or the complement of the nucleotides sequence, respectively. The term "sub-sequence" or "subsequence" can also refer to a region of a nucleotide sequence.

The term "downstream," when referring to a nucleotide sequence, means that a nucleic acid or a nucleotide sequence is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence.

As used herein, the term "regulatory region" refers to nucleotide sequences located upstream (5' non-coding sequences), within, or downstream (3' non-coding sequences) of a coding region, and which influence the transcription, RNA processing, stability, or translation of the associated coding region. Regulatory regions can include promoters, translation leader sequences, introns, polyadenylation recognition sequences, RNA processing sites, effector binding sites, UTRs, and stem-loop structures. If a coding region is intended for expression in a eukaryotic cell, a polyadenylation signal and transcription termination sequence will usually be located 3' to the coding sequence.

The term "transcript" as used herein can refer to a primary transcript that is synthesized by transcription of DNA and becomes a messenger RNA (mRNA) after processing, i.e., a precursor messenger RNA (pre-mRNA), and the processed mRNA itself. The term "transcript" can be interchangeably used with "pre-mRNA" and "mRNA." After DNA strands are transcribed to primary transcripts, the newly synthesized primary transcripts are modified in several ways to be converted to their mature, functional forms to produce different proteins and RNAs such as mRNA, tRNA, rRNA, lncRNA, miRNA and others. Thus, the term "transcript" can include exons, introns, 5' UTRs, and 3' UTRs.

The term "expression" as used herein refers to a process by which a polynucleotide produces a gene product, for example, a RNA or a polypeptide. It includes, without limitation, transcription of the polynucleotide into messenger RNA (mRNA) and the translation of an mRNA into a polypeptide. Expression produces a "gene product." As used herein, a gene product can be either a nucleic acid, e.g., a messenger RNA produced by transcription of a gene, or a polypeptide which is translated from a transcript. Gene products described herein further include nucleic acids with post transcriptional modifications, e.g., polyadenylation or splicing, or polypeptides with post translational modifications, e.g., methylation, glycosylation, the addition of lipids, association with other protein subunits, or proteolytic cleavage.

The terms "identical" or percent "identity" in the context of two or more nucleic acids refer to two or more sequences that are the same or have a specified percentage of nucleotides or amino acid residues that are the same, when compared and aligned (introducing gaps, if necessary) for maximum correspondence, not considering any conservative amino acid substitutions as part of the sequence identity. The percent identity can be measured using sequence comparison software or algorithms or by visual inspection. Various algorithms and software are known in the art that can be used to obtain alignments of amino acid or nucleotide sequences.

One such non-limiting example of a sequence alignment algorithm is the algorithm described in Karlin et al., 1990, *Proc. Natl. Acad. Sci.*, 87:2264-2268, as modified in Karlin et al., 1993, *Proc. Natl. Acad. Sci.*, 90:5873-5877, and incorporated into the NBLAST and XBLAST programs (Altschul et al., 1991, *Nucleic Acids Res.*, 25:3389-3402). In certain embodiments, Gapped BLAST can be used as described in Altschul et al., 1997, *Nucleic Acids Res.* 25:3389-3402. BLAST-2, WU-BLAST-2 (Altschul et al., 1996, *Methods in Enzymology*, 266:460-480), ALIGN, ALIGN-2 (Genentech, South San Francisco, Calif.) or Megalign (DNASTAR) are additional publicly available software programs that can be used to align sequences. In certain embodiments, the percent identity between two nucleotide sequences is determined using the GAP program in the GCG software package (e.g., using a NWSgapdna.CMP matrix and a gap weight of 40, 50, 60, 70, or 90 and a length weight of 1, 2, 3, 4, 5, or 6). In certain alternative embodiments, the GAP program in the GCG software package, which incorporates the algorithm of Needleman and Wunsch (*J. Mol. Biol.* (48):444-453 (1970)) can be used to determine the percent identity between two amino acid sequences (e.g., using either a BLOSUM 62 matrix or a PAM250 matrix, and a gap weight of 16, 14, 12, 10, 8, 6, or 4 and a length weight of 1, 2, 3, 4, 5). Alternatively, in certain embodiments, the percent identity between nucleotide or amino acid sequences is determined using the algorithm of Myers and Miller (CABIOS, 4:11-17 (1989)). For example, the percent identity can be determined using the ALIGN program (version 2.0) and using a PAM120 with residue table, a gap length penalty of 12 and a gap penalty of 4. One skilled in the art can determine appropriate parameters for maximal alignment by particular alignment software. In certain embodiments, the default parameters of the alignment software are used.

In certain embodiments, the percentage identity "X" of a first nucleotide sequence to a second nucleotide sequence is calculated as 100×(Y/Z), where Y is the number of amino acid residues scored as identical matches in the alignment of the first and second sequences (as aligned by visual inspection or a particular sequence alignment program) and Z is the total number of residues in the second sequence. If the length of a first sequence is longer than the second sequence, the percent identity of the first sequence to the second sequence will be higher than the percent identity of the second sequence to the first sequence.

Different regions within a single polynucleotide target sequence that align with a polynucleotide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

As used herein, the terms "homologous" and "homology" are interchangeable with the terms "identity" and "identical."

The term "naturally occurring variant thereof" refers to variants of the CAMK2D polypeptide sequence or CAMK2D nucleic acid sequence (e.g., transcript) which exist naturally within the defined taxonomic group, such as mammalian, such as mouse, monkey, and human. Typically, when referring to "naturally occurring variants" of a polynucleotide the term also can encompass any allelic variant of the CAMK2D-encoding genomic DNA which is found at Chromosomal position 4q26 (i.e., residues 113,451,032 to 113,761,927 of GenBank Accession No. NC_000004.12) by chromosomal translocation or duplication, and the RNA, such as mRNA derived therefrom. "Naturally occurring variants" can also include variants derived from alternative splicing of the CAMK2D mRNA. When referenced to a specific polypeptide sequence, e.g., the term also includes naturally occurring forms of the protein, which can therefore be processed, e.g., by co- or post-translational modifications, such as signal peptide cleavage, proteolytic cleavage, glycosylation, etc.

In determining the degree of "complementarity" between the ASOs of the disclosure (or regions thereof) and the target region of the nucleic acid which encodes mammalian CAMK2D (e.g., the CAMK2D gene), such as those disclosed herein, the degree of "complementarity" (also, "homology" or "identity") is expressed as the percentage identity (or percentage homology) between the sequence of the ASO (or region thereof) and the sequence of the target region (or the reverse complement of the target region) that best aligns therewith. The percentage is calculated by counting the number of aligned bases that are identical between the two sequences, dividing by the total number of contiguous monomers in the ASO, and multiplying by 100. In such a comparison, if gaps exist, it is preferable that such gaps are merely mismatches rather than areas where the number of monomers within the gap differs between the ASO of the disclosure and the target region.

The term "complement" as used herein indicates a sequence that is complementary to a reference sequence. It is well known that complementarity is the base principle of DNA replication and transcription as it is a property shared between two DNA or RNA sequences, such that when they are aligned antiparallel to each other, the nucleotide bases at each position in the sequences will be complementary, much like looking in the mirror and seeing the reverse of things. Therefore, for example, the complement of a sequence of 5'"ATGC"3' can be written as 3'"TACG"5' or 5'"GCAT"3'. The terms "reverse complement", "reverse complementary", and "reverse complementarity" as used herein are interchangeable with the terms "complement", "complementary", and "complementarity." In some embodiments, the term "complementary" refers to 100% match or complementarity (i.e., fully complementary) to a contiguous nucleic acid sequence within a CAMK2D transcript. In some embodiments, the term "complementary" refers to at least about 80%, at least about 85%, at least about 90%, at least about 91%, at least about 92%, at least about 93%, at least about 94%, at least about 95%, at least about 96%, at least about 97%, at least about 98%, or at least about 99% match or complementarity to a contiguous nucleic acid sequence within a CAMK2D transcript.

The terms "corresponding to" and "corresponds to," when referencing two separate nucleic acid or nucleotide sequences can be used to clarify regions of the sequences that correspond or are similar to each other based on homology and/or functionality, although the nucleotides of the specific sequences can be numbered differently. For example, different isoforms of a gene transcript can have similar or conserved portions of nucleotide sequences whose numbering can differ in the respective isoforms based on alternative splicing and/or other modifications. In addition, it is recognized that different numbering systems can be employed when characterizing a nucleic acid or nucleotide sequence (e.g., a gene transcript and whether to begin numbering the sequence from the translation start codon or to include the 5'UTR). Further, it is recognized that the nucleic acid or nucleotide sequence of different variants of a gene or gene transcript can vary. As used herein, however, the regions of the variants that share nucleic acid or nucleotide sequence homology and/or functionality are deemed to "correspond" to one another. For example, a nucleotide sequence of a CAMK2D transcript corresponding to nucleotides X to Y of SEQ ID NO: 1 ("reference sequence") refers to an CAMK2d transcript sequence (e.g., CAMK2D pre-mRNA or mRNA) that has an identical sequence or a similar sequence to nucleotides X to Y of SEQ ID NO: 1, wherein X is the start site and Y is the end site (as shown in FIGS. 1A and 1B). A person of ordinary skill in the art can identify the corresponding X and Y residues in the CAMK2D transcript sequence by aligning the CAMK2D transcript sequence with SEQ ID NO: 1.

The terms "corresponding nucleotide analog" and "corresponding nucleotide" are intended to indicate that the nucleobase in the nucleotide analog and the naturally occurring nucleotide have the same pairing, or hybridizing, ability. For example, when the 2-deoxyribose unit of the nucleotide is linked to an adenine, the "corresponding nucleotide analog" contains a pentose unit (different from 2-deoxyribose) linked to an adenine.

The term "DES Number" or "DES No." as used herein refers to a unique number given to a nucleotide sequence having a specific pattern of nucleosides (e.g., DNA) and nucleoside analogs (e.g., LNA). As used herein, the design of an ASO is shown by a combination of upper case letters and lower case letters. For example, DES-0231 refers to an ASO sequence of tacatattatattactcctc (SEQ ID NO: 158) with an ASO design of LLLDDDDDDDDDDDDDDDLLL (i.e., TACatattatattactcCTC), wherein the L (i.e., upper case letter) indicates a nucleoside analog (e.g., LNA) and the D (i.e., lower case letter) indicates a nucleoside (e.g., DNA).

The annotation of ASO chemistry is as follows Beta-D-oxy LNA nucleotides are designated by OxyB where B designates a nucleotide base such as thymine (T), uridine (U), cytosine (C), 5-methylcytosine (MC), adenine (A) or guanine (G), and thus include OxyA, OxyT, OxyMC, OxyC and OxyG. DNA nucleotides are designated by DNAb, where the lower case b designates a nucleotide base such as thymine (T), uridine (U), cytosine (C), 5-methylcytosine (Mc), adenine (A) or guanine (G), and thus include DNAa, DNAt, DNA and DNAg. The letter M before C or c indicates 5-methylcytosine. The letter "s" indicates a phosphorothioate internucleotide linkage.

The term "ASO Number" or "ASO No." as used herein refers to a unique number given to a nucleotide sequence having the detailed chemical structure of the components, e.g., nucleosides (e.g., DNA), nucleoside analogs (e.g., beta-D-oxy-LNA), nucleobase (e.g., A, T, G, C, U, or MC), and backbone structure (e.g., phosphorothioate or phosphorodiester). For example, ASO-0231 can refer to OxyTs OxyAs OxyMCs DNAas DNAts DNAas DNAts DNAts DNAas DNAts DNAas DNAts DNAts DNAas DNAcs DNAts DNAcs OxyMCs OxyTs OxyMC.

"Potency" is normally expressed as an $IC_{50}$ or $EC_{50}$ value, in µM, nM or pM unless otherwise stated. Potency can also be expressed in terms of percent inhibition. $IC_{50}$ is the median inhibitory concentration of a therapeutic molecule. $EC_{50}$ is the median effective concentration of a therapeutic molecule relative to a vehicle or control (e.g., saline). In functional assays, $IC_{50}$ is the concentration of a therapeutic molecule that reduces a biological response, e.g., transcription of mRNA or protein expression, by 50% of the biological response that is achieved by the therapeutic molecule. In functional assays, $EC_{50}$ is the concentration of a therapeutic molecule that produces 50% of the biological response, e.g., transcription of mRNA or protein expression. $IC_{50}$ or $EC_{50}$ can be calculated by any number of means known in the art.

As used herein, the term "inhibiting," e.g., the expression of CAMK2D gene transcript and/or CAMK2D protein refers to the ASO reducing the expression of the CAMK2D gene transcript and/or CAMK2D protein in a cell or a tissue. In some embodiments, the term "inhibiting" refers to complete inhibition (100% inhibition or non-detectable level) of CAMK2D gene transcript or CAMK2D protein. In other embodiments, the term "inhibiting" refers to at least 5%, at least 10%, at least 15%, at least 20%, at least 25%, at least 30%, at least 35%, at least 40%, at least 45%, at least 50%, at least 60%, at least 70%, at least 80%, at least 90%, at least 95% or at least 99% inhibition of CAMK2D gene transcript and/or CAMK2D protein expression in a cell or a tissue.

By "subject" or "individual" or "animal" or "patient" or "mammal," is meant any subject, particularly a mammalian subject, for whom diagnosis, prognosis, or therapy is desired. Mammalian subjects include humans, domestic animals, farm animals, sports animals, and zoo animals including, e.g., humans, non-human primates, dogs, cats, guinea pigs, rabbits, rats, mice, horses, cattle, bears, and so on.

The term "pharmaceutical composition" refers to a preparation which is in such form as to permit the biological activity of the active ingredient to be effective, and which contains no additional components which are unacceptably toxic to a subject to which the composition would be administered. Such composition can be sterile.

An "effective amount" of an ASO as disclosed herein is an amount sufficient to carry out a specifically stated purpose. An "effective amount" can be determined empirically and in a routine manner, in relation to the stated purpose.

Terms such as "treating" or "treatment" or "to treat" or "alleviating" or "to alleviate" refer to both (1) therapeutic measures that cure, slow down, lessen symptoms of, and/or halt progression of a diagnosed pathologic condition or disorder and (2) prophylactic or preventative measures that prevent and/or slow the development of a targeted pathologic condition or disorder. Thus, those in need of treatment include those already with the disorder; those prone to have the disorder; and those in whom the disorder is to be prevented. In certain embodiments, a subject is successfully "treated" for a disease or condition disclosed elsewhere herein according to the methods provided herein if the patient shows, e.g., total, partial, or transient alleviation or elimination of symptoms associated with the disease or disorder.

II. Antisense Oligonucleotides

The present disclosure employs antisense oligonucleotides (ASOs) for use in modulating the function of nucleic acid molecules encoding mammalian CAMK2D, such as the CAMK2D nucleic acid, e.g., CAMK2D transcript, including CAMK2D pre-mRNA, and CAMK2D mRNA, or naturally occurring variants of such nucleic acid molecules encoding mammalian CAMK2D. The term "ASO" in the context of the present disclosure, refers to a molecule formed by covalent linkage of two or more nucleotides (i.e., an oligonucleotide).

The ASO comprises a contiguous nucleotide sequence of from about 10 to about 30, such as 10-20, 14-20, 16-20, or 15-25, nucleotides in length. The terms "antisense ASO," "antisense oligonucleotide," and "oligomer" as used herein are interchangeable with the term "ASO."

A reference to a SEQ ID number includes a particular nucleobase sequence, but does not include any design or full chemical structure. Furthermore, the ASOs disclosed in the figures herein show a representative design, but are not limited to the specific design shown in the Figures unless otherwise indicated. Herein, a single nucleotide (unit) can also be referred to as a monomer or unit. When this specification refers to a specific ASO number, the reference includes the sequence, the specific ASO design, and the chemical structure. When this specification refers to a specific DES number, the reference includes the sequence and the specific ASO design. For example, when a claim (or this specification) refers to SEQ ID NO: 158, it includes the nucleotide sequence of tacatattatattactcctc only. When a claim (or the specification) refers to DES-0231, it includes the nucleotide sequence of tacatattatattactcctc with the ASO design of TACatattatattactcCTC. Alternatively, the design of ASO-0231 can also be written as SEQ ID NO: 158, wherein each of the first nucleotide, the second nucleotide, the third nucleotide, the $18^{th}$ nucleotide, the $19^{th}$ nucleotide, and the $20^{th}$ nucleotide from the 5' end is a modified nucleotide, e.g., LNA, and each of the other nucleotides is a non-modified nucleotide (e.g., DNA). The ASO number includes the sequence and the ASO design, as well as the specific details of the ASO. Therefore, for instance, ASO-0231 referred to in this application indicates OxyTs OxyAs OxyMCs DNAas DNAts DNAas DNAts DNAts DNAas DNAts DNAas DNAts DNAts DNAas DNAcs DNAts DNAcs OxyMCs OxyTs OxyMC, wherein "s" indicates phosphorothioate linkage.

In various embodiments, the ASO of the disclosure does not comprise RNA (units). In some embodiments, the ASO comprises one or more DNA units. In one embodiment, the ASO according to the disclosure is a linear molecule or is synthesized as a linear molecule. In some embodiments, the ASO is a single stranded molecule, and does not comprise short regions of, for example, at least 3, 4 or 5 contiguous nucleotides, which are complementary to equivalent regions within the same ASO (i.e. duplexes)—in this regard, the ASO is not (essentially) double stranded. In some embodiments, the ASO is essentially not double stranded. In some embodiments, the ASO is not a siRNA. In various embodiments, the ASO of the disclosure can consist entirely of the contiguous nucleotide region. Thus, in some embodiments the ASO is not substantially self-complementary.

In other embodiments, the present disclosure includes fragments of ASOs. For example, the disclosure includes at least one nucleotide, at least two contiguous nucleotides, at least three contiguous nucleotides, at least four contiguous nucleotides, at least five contiguous nucleotides, at least six contiguous nucleotides, at least seven contiguous nucleotides, at least eight contiguous nucleotides, or at least nine contiguous nucleotides of the ASOs disclosed herein. Fragments of any of the sequences disclosed herein are contemplated as part of the disclosure.

II.A. The Target

Suitably the ASO of the disclosure is capable of down-regulating (e.g., reducing or removing) expression of the CAMK2D mRNA or protein. In this regard, the ASO of the disclosure can affect indirect inhibition of CAMK2D protein through the reduction in CAMK2D mRNA levels, typically in a mammalian cell, such as a human cell, such as a cardiocyte. In particular, the present disclosure is directed to ASOs that target one or more regions of the CAMK2D pre-mRNA (e.g., intron regions, exon regions, and/or exon-intron junction regions). Unless indicated otherwise, the term "CAMK2D," as used herein, can refer to CAMK2D from one or more species (e.g., humans, non-human primates, dogs, cats, guinea pigs, rabbits, rats, mice, horses, cattle, and bears).

Calcium/calmodulin-dependent protein kinase type II delta (CAMK2D) is also known as CaM kinase II subunit delta and CamK-II subunit delta. Synonyms of CAMK2D are known and include CaMKIIδ or CAMKD. The sequence for the human CAMK2D gene can be found under publicly available GenBank Accession Number NC_000004.12. The sequence for the human CAMK2D pre-mRNA transcript (SEQ ID NO: 1) corresponds to the reverse complement of residues 113,451,032-113,761,927 of NC_000004.12. The CAMK2D mRNA sequence (GenBank Accession No. NM_001221.3) is provided in SEQ ID NO: 2, except that the nucleotide "t" in SEQ ID NO: 2 is shown as "u" in the mRNA. The sequence for human CAMK2D protein can be found under publicly available Accession Numbers: Q13557 (canonical sequence, SEQ ID NO: 3), A8MVS8, Q52PK4, Q59G21, Q8N553, Q9UGH6, Q9UQE9, each of which is incorporated by reference herein in its entirety.

Natural variants of the human CAMK2D gene product are known. For example, natural variants of human CAMK2D protein can contain one or more amino acid substitutions selected from: D167E, Q463E, and T493I, and any combinations thereof. Additional variants of human CAMK2D protein resulting from alternative splicing are also known in the art. CAMK2D Isoform Delta 3 (identifier: Q13557-3 at UniProt) differs from the canonical sequence (SEQ ID NO: 3) as follows: 328-328: K KKRKSSSSVQMM. The sequence of CAMK2D Isoform Delta 4 (identifier: Q13557-4) differs from the canonical sequence (SEQ ID NO: 3) as follows: 328-328: K→KINNKANVVTSPKENIPTPAL. The sequence of CAMK2D Isoform Delta 6 (identifier: Q13557-8) differs from the canonical sequence (SEQ ID NO: 3) as follows: 479-499: Missing. The sequence of CAMK2D Isoform Delta 7 (identifier: Q13557-9) differs from the canonical sequence (SEQ ID NO: 3) as follows: 328-328: K→KKRKSSSSVQMM and 479-499: Missing. The sequence of CAMK2D Isoform Delta 8 (identifier: Q13557-5) differs from the canonical sequence (SEQ ID NO: 3) as follows: 328-328: K→KINNKANVVTSPKENIPTPAL and 479-499: Missing. The sequence of CAMK2D Isoform Delta 9 (identifier: Q13557-6) differs from the canonical sequence (SEQ ID NO: 3) as follows: 329-329: E→EPQTTVIHNPDGNKE. The sequence of CAMK2D Isoform Delta 10 (identifier: Q13557-10) differs from the canonical sequence (SEQ ID NO: 3) as follows: 329-329: E→EPQTTVIHNPDGNKE and 479-499: Missing. The sequence of CAMK2D Isoform Delta 11 (identifier: Q13557-11) differs from the canonical sequence (SEQ ID NO: 3) as follows: 328-328: K→KKRKSSSSVQMMEPQTTVIHNPDGNK. The sequence of CAMK2D Isoform Delta 12 (identifier: Q13557-12) differs from the canonical sequence (SEQ ID NO: 3) as follows: 478-478: K→N and 479-499: Missing. Therefore, the ASOs of the present disclosure can be designed to reduce or inhibit expression of the natural variants of the CAMK2D protein.

An example of a target nucleic acid sequence of the ASOs is CAMK2D pre-mRNA. SEQ ID NO: 1 represents a human CAMK2D genomic sequence (i.e., reverse complement of nucleotides 113,451,032 to 113,761,927 of GenBank Accession No. NC_000004.12). SEQ ID NO: 1 is identical to a CAMK2D pre-mRNA sequence except that nucleotide "t" in SEQ ID NO: 1 is shown as "u" in pre-mRNA. In certain embodiments, the "target nucleic acid" comprises an intron of a CAMK2D protein-encoding nucleic acids or naturally occurring variants thereof, and RNA nucleic acids derived therefrom, e.g., pre-mRNA. In other embodiments, the target nucleic acid comprises an exon region of a CAMK2D protein-encoding nucleic acids or naturally occurring variants thereof, and RNA nucleic acids derived therefrom, e.g., pre-mRNA. In yet other embodiments, the target nucleic acid comprises an exon-intron junction of a CAMK2D protein-encoding nucleic acids or naturally occurring variants thereof, and RNA nucleic acids derived therefrom, e.g., pre-mRNA. In some embodiments, for example when used in research or diagnostics the "target nucleic acid" can be a cDNA or a synthetic oligonucleotide derived from the above DNA or RNA nucleic acid targets. The human CAMK2D protein sequence encoded by the CAMK2D pre-mRNA is shown as SEQ ID NO: 3. In other embodiments, the target nucleic acid comprises an untranslated region of a CAMK2D protein-encoding nucleic acids or naturally occurring variants thereof, e.g., 5' UTR, 3' UTR, or both.

In some embodiments, an ASO of the disclosure hybridizes to a region within the introns of a CAMK2D transcript, e.g., SEQ ID NO: 1. In certain embodiments, an ASO of the disclosure hybridizes to a region within the exons of a CAMK2D transcript, e.g., SEQ ID NO: 1. In other embodiments, an ASO of the disclosure hybridizes to a region within the exon-intron junction of a CAMK2D transcript, e.g., SEQ ID NO: 1. In some embodiments, an ASO of the disclosure hybridizes to a region within a CAMK2D transcript (e.g., an intron, exon, or exon-intron junction), e.g., SEQ ID NO: 1, wherein the ASO has a design according to formula: 5' A-B-C 3' as described elsewhere herein (e.g., Section II.G).

In some embodiments, the ASO targets a mRNA encoding a particular isoform of

CAMK2D protein (e.g., Isoform Delta 3-12). In some embodiments, the ASO targets all isoforms of CAMK2D protein. In other embodiments, the ASO targets two isoforms (e.g., Isoform Delta 3 and Isoform Delta 7, Isoform Delta 4 and Isoform Delta 8, and Isoform Delta 9 and Isoform Delta 10) of CAMK2D protein.

In some embodiments, the ASO comprises a contiguous nucleotide sequence (e.g., 10 to 30 nucleotides in length) that are complementary to a nucleic acid sequence within a CAMK2D transcript, e.g., a region corresponding to SEQ ID NO: 1. In some embodiments, the ASO comprises a contiguous nucleotide sequence that hybridizes to a nucleic acid sequence, or a region within the sequence, of a CAMK2D transcript ("target region"), wherein the nucleic acid sequence corresponds to nucleotides (i) nucleotides 625-842 of SEQ ID NO: 1; (ii) nucleotides 1,398-59,755 of SEQ ID NO: 1; (iii) nucleotides 61,817-104,725 of SEQ ID NO: 1; (iv) nucleotides 112,162-118,021 of SEQ ID NO: 1; (v) nucleotides 119,440-135,219 of SEQ ID NO: 1; (vi) nucleotides 137,587-157,856 of SEQ ID NO: 1; (vii) nucleotides 159,191-266,174 of SEQ ID NO: 1; and (viii) nucleotides 272,788-310,949 of SEQ ID NO: 1, and wherein, optionally, the ASO has one of the designs described herein (e.g., Section II.G) or a chemical structure shown elsewhere herein (e.g., FIGS. 1A and 1B).

In some embodiments, the target region corresponds to nucleotides 725-742 of SEQ ID NO: 1. In other embodiments, the target region corresponds to nucleotides 1,498-59,655 of SEQ ID NO: 1. In certain embodiments, the target region corresponds to nucleotides 61,917-104,625 of SEQ ID NO: 1. In some embodiments, the target region corresponds to nucleotides 112,262-117,921 of SEQ ID NO: 1. In some embodiments, the target region corresponds to nucleotides 119,540-135,119 of SEQ ID NO: 1. In further embodiments, the target region corresponds to nucleotides 137,687-157,756 of SEQ ID NO: 1. In certain embodiments, the target region corresponds to nucleotides 159,291-266,074 of SEQ ID NO: 1. In some embodiments, the target region corresponds to nucleotides 272,888-310,849 of SEQ ID NO: 1.

In some embodiments, the target region corresponds to nucleotides 725-742 of SEQ ID NO: 1±10, ±20, ±30, ±40, ±50, ±60, ±70, ±80, or ±90 nucleotides at the 3' end and/or the 5' end. In other embodiments, the target region corresponds to nucleotides 1,498-59,655 of SEQ ID NO: 1±10, ±20, ±30, ±40, ±50, ±60, ±70, ±80, or ±90 nucleotides at the 3' end and/or the 5' end. In certain embodiments, the target region corresponds to nucleotides 61,917-104,625 of SEQ ID NO: 1±10, ±20, ±30, ±40, ±50, ±60, ±70, ±80, or ±90 nucleotides at the 3' end and/or the 5' end. In some embodiments, the target region corresponds to nucleotides 112,262-117,921 of SEQ ID NO: 1±10, ±20, ±30, ±40, ±50, ±60, ±70, ±80, or ±90 nucleotides at the 3' end and/or the 5' end. In some embodiments, the target region corresponds to nucleotides 119,540-135,119 of SEQ ID NO: 1±10, ±20, ±30, ±40, ±50, ±60, ±70, ±80, or ±90 nucleotides at the 3' end and/or the 5' end. In further embodiments, the target region corresponds to nucleotides 137,687-157,756 of SEQ ID NO: 1±10, ±20, ±30, ±40, ±50, ±60, ±70, ±80, or ±90 nucleotides at the 3' end and/or the 5' end. In certain embodiments, the target region corresponds to nucleotides 159,291-266,074 of SEQ ID NO: 1±10, ±20, ±30, ±40, ±50, ±60, ±70, ±80, or ±90 nucleotides at the 3' end and/or the 5' end. In some embodiments, the target region corresponds to nucleotides 272,888-310,849 of SEQ ID NO: 1±10, ±20, ±30, ±40, ±50, ±60, ±70, ±80, or ±90 nucleotides at the 3' end and/or the 5' end.

In some embodiments, the ASO of the present disclosure hybridizes to multiple target regions within the CAMK2D transcript (e.g., pre-mRNA, SEQ ID NO: 1). In some embodiments, the ASO hybridizes to two different target regions within the CAMK2D transcript. In some embodiments, the ASO hybridizes to three different target regions within the CAMK2D transcript. The sequences of exemplary ASOs that hybridizes to multiple target regions, and the start/end sites of the different target regions are provided in FIG. 1B. In some embodiments, the ASOs that hybridizes to multiple regions within the CAMK2D transcript (e.g., pre-mRNA, SEQ ID NO: 1) are more potent (e.g., having lower EC50) at reducing CAMK2D expression compared to ASOs that hybridizes to a single region within the CAMK2D transcript (e.g., pre-mRNA, SEQ ID NO: 1).

In some embodiments, the ASO of the disclosure is capable of hybridizing to the target nucleic acid (e.g., CAMK2D transcript) under physiological condition, i.e., in vivo condition. In some embodiments, the ASO of the disclosure is capable of hybridizing to the target nucleic acid (e.g., CAMK2D transcript) in vitro. In some embodiments, the ASO of the disclosure is capable of hybridizing to the target nucleic acid (e.g., CAMK2D transcript) in vitro under stringent conditions. Stringency conditions for hybridization in vitro are dependent on, inter alia, productive cell uptake, RNA accessibility, temperature, free energy of association, salt concentration, and time (see, e.g., Stanley T Crooke, Antisense Drug Technology: Principles, Strategies and Applications, $2^{nd}$ Edition, CRC Press (2007)). Generally, conditions of high to moderate stringency are used for in vitro hybridization to enable hybridization between substantially similar nucleic acids, but not between dissimilar nucleic acids. An example of stringent hybridization conditions includes hybridization in 5× saline-sodium citrate (SSC) buffer (0.75 M sodium chloride/0.075 M sodium citrate) for 1 hour at 40° C., followed by washing the sample 10 times in 1×SSC at 40° C. and 5 times in 1×SSC buffer at room temperature. In vivo hybridization conditions consist of intracellular conditions (e.g., physiological pH and intracellular ionic conditions) that govern the hybridization of antisense oligonucleotides with target sequences. In vivo conditions can be mimicked in vitro by relatively low stringency conditions. For example, hybridization can be carried out in vitro in 2×SSC (0.3 M sodium chloride/0.03 M sodium citrate), 0.1% SDS at 37° C. A wash solution containing 4×SSC, 0.1% SDS can be used at 37° C., with a final wash in 1×SSC at 45° C.

In some embodiments, the ASO of the present disclosure is capable of targeting a CAMK2D transcript from one or more species (e.g., humans, non-human primates, dogs, cats, guinea pigs, rabbits, rats, mice, horses, cattle, and bears). In certain embodiments, the ASO disclosed herein is capable of targeting both human and rodent (e.g., mice or rats) CAMK2D transcript. Accordingly, in some embodiments, the ASO is capable of down-regulating (e.g., reducing or removing) expression of the CAMK2D mRNA or protein both in humans and in rodents (e.g., mice or rats).

Sequences of mouse CAMK2D transcript are known in the art. For instance, the sequence for the mouse CAMK2D gene can be found under publicly available GenBank Accession Number NC_000069.6. The sequence for the mouse CAMK2D pre-mRNA transcript corresponds to residues 126,596,354-126,846,326 of NC_000069.6. The sequences for mouse CAMK2D mRNA transcript (both canonical and variants) are known and available as Accession Numbers NM_001025438.2 (canonical sequence), NM_001025439.2, NM_001293663.1, NM_001293664.1, NM_023813.4, NM_001346635.1, NM_001346636.1, NM_001293665.1, XM_006500836.3, XM_006500833.3, XM_006500835.3, XM_017319415.1, XM_006500818.3, XM_017319417.1, XM_017319418.1, XM_017319420.1, NM_001293666.1, XM_006500819.3, XM_017319416.1, XM_006500820.3, XM_006500822.3, XM_006500823.3, XM_006500824.3, XM_017319419.1, XM_006500826.3, XM_006500825.3, XM_006500829.3, BC052894.1, XM_006500831.3, XM_006500832.3, XM_017319422.1, XM_006500834.3, XM_006500839.3, and XM_017319421.1. The sequence of mouse CAMK2D protein can be found under publicly available Accession Numbers: Q6PHZ2 (canonical sequence), Q3UF87, Q3UQH9, Q5DTK4, Q8CAC5, and Q9CZE2, each of which is incorporated by reference herein in its entirety. Three isoforms of the mouse CAMK2D protein are known. The sequence of CAMK2D Isoform Delta 6 differs from the canonical sequence as follows: 478-478: K→N and 479-499: Missing. The sequence of CAMK2D Isoform Delta 10 differs from the canonical as follows: 329-329: E→EPQTTVIHNPDGNKE; 478-478: K→N; and 479-499: Missing. The sequence of CAMK2D Isoform Delta 5 differs from the canonical sequence (as follows: 328-328: K→KINNKANVVTSPKENIPT-PALEPQTTVIHNPDGNK; 478-478: K→N; and 479-499: Missing.

Sequences of rat CAMK2D transcript are also known in the art. The rat CAMK2D gene can be found under publicly available GenBank Accession Number NC_005101.4. The sequence for the rat CAMK2D pre-mRNA transcript corresponds to residues 230,900,907-231,132,207 of NC_005101.4. The sequences for rat CAMK2D mRNA transcript (both canonical and variants) are known and available as Accession Number NM_012519.2 (canonical sequence), BC107562.1, XM_017590621.1, XM_017590605.1, XM_008761452.1, XM_017590606.1, XM_017590607.1, XM_017590608.1, XM_017590610.1, XM_017590611.1, XM_017590612.1, XM_006233285.3, XM_017590614.1, XM_017590615.1, XM_017590616.1, XM_017590613.1, XM_017590617.1, XM_017590618.1, XM_017590604.1, XM_017590609.1, XM_017590624.1, XM_017590625.1, XM_017590619.1, XM_017590620.1, XM_017590622.1, and XM_017590623.1. The sequence of rat CAMK2D protein can be found under publicly available Accession Numbers: P15791 (canonical sequence), P97915, P97916, Q3B7LO, Q63904, Q63905, Q63906, Q63907, and Q63908, each of which is incorporated by reference herein in its entirety. Six isoforms of rat CAMK2D protein are known. The sequence of CAMK2D Isoform Delta 2 differs from the canonical sequence as follows: 329-362: Missing. The sequence of CAMK2D Isoform Delta 3 differs from the canonical sequence as follows: 329-335: INNKANV→KRKSSSV; 337-359: Missing; and 360-362: GNK→QMM. The sequence of CAMK2D Isoform Delta 4 differs from the canonical sequence as follows: 349-362: Missing. The sequence of CAMK2D Isoform Delta 5 differs from the canonical sequence as follows: 329-362: Missing and 512-533: KPPCIPNGKENFSGGTSLWQNI→N. The sequence of CAMK2D Isoform Delta 6 differs from the canonical sequence as follows: 512-533: KPPCIPNGKENFSGGTSLWQNI→N. The sequence of CAMK2D Isoform Delta 7 differs from the canonical sequence as follows: 349-362: Missing and 512-533: KPPCIPNGKENFSGGTSLWQNI→N.

II.B. ASO Sequences

The ASOs of the disclosure comprise a contiguous nucleotide sequence which corresponds to the complement of a region of CAMK2D transcript, e.g., a nucleotide sequence corresponding to SEQ ID NO: 1.

In certain embodiments, the disclosure provides an ASO from 10-30, such as 10-15 nucleotides, 10-20 nucleotides, or 10-25 nucleotides in length, wherein the contiguous nucleotide sequence has at least about 80%, at least about 85%, at least about 90%, at least about 95%, at least about 96%, at least about 97%, at least about 98%, at least about 99%, or about 100% sequence identity to a region within the complement of a CAMK2D transcript, such as SEQ ID NO: 1 or naturally occurring variant thereof. Thus, for example, the ASO hybridizes to a single stranded nucleic acid molecule having the sequence of SEQ ID NO: 1 or a portion thereof.

The ASO can comprise a contiguous nucleotide sequence which is fully complementary (perfectly complementary) to the equivalent region of a nucleic acid which encodes a mammalian CAMK2D protein (e.g., SEQ ID NO: 1). The ASO can comprise a contiguous nucleotide sequence which is fully complementary (perfectly complementary) to a nucleic acid sequence, or a region within the sequence, corresponding to nucleotides X—Y of SEQ ID NO: 1, wherein X and Y are the start site and the end site, respectively, as shown in FIGS. 1A and 1B.

In some embodiments, the nucleotide sequence of the ASOs of the disclosure or the contiguous nucleotide sequence has at least about 80% sequence identity to a sequence selected from SEQ ID NOs: 4 to 1713 (i.e., the sequences in FIGS. 1A and 1B), such as at least about 80%, at least about 85%, at least about 90%, at least about 91%, at least about 92%, at least about 93%, at least about 94%, at least about 95%, at least about 96% sequence identity, at least about 97% sequence identity, at least about 98% sequence identity, at least about 99% sequence identity, such as about 100% sequence identity (homologous). In some embodiments, the ASO has a design described elsewhere herein (e.g., Section II.G) or a chemical structure shown elsewhere herein (e.g., FIGS. 1A and 1B).

In some embodiments the ASO (or contiguous nucleotide portion thereof) is selected from, or comprises, one of the sequences selected from the group consisting of SEQ ID NOs: 4 to 1713 or a region of at least 10 contiguous nucleotides thereof, wherein the ASO (or contiguous nucleotide portion thereof) can optionally comprise one, two, three, or four mismatches when compared to the corresponding CAMK2D transcript.

In some embodiments, the ASO comprises a sequence selected from the group consisting of SEQ ID NO: 254, SEQ ID NO: 27, SEQ ID NO: 114, SEQ ID NO: 158, SEQ ID NO: 190, SEQ ID NO: 327, SEQ ID NO: 463, SEQ ID NO: 513, SEQ ID NO: 516, SEQ ID NO: 519, SEQ ID NO: 657, SEQ ID NO: 659, SEQ ID NO: 827, SEQ ID NO: 1249, SEQ ID NO: 1326, SEQ ID NO: 1409, SEQ ID NO: 1524, SEQ ID NO: 1530, SEQ ID NO: 1662, and SEQ ID NO: 1676.

In some embodiments, the ASO comprises a sequence selected from the group consisting of SEQ ID NO: 55, SEQ ID NO: 61, SEQ ID NO: 63, SEQ ID NO: 71, SEQ ID NO: 75, SEQ ID NO: 79, SEQ ID NO: 84, SEQ ID NO: 85, SEQ ID NO: 92, SEQ ID NO: 102, SEQ ID NO: 105, SEQ ID NO: 128, SEQ ID NO: 130, SEQ ID NO: 133, SEQ ID NO: 138, SEQ ID NO: 161, SEQ ID NO: 178, SEQ ID NO: 180, SEQ ID NO: 186, SEQ ID NO: 195, SEQ ID NO: 200, SEQ ID NO: 202, SEQ ID NO: 234, SEQ ID NO: 264, SEQ ID NO: 387, SEQ ID NO: 390, SEQ ID NO: 396, SEQ ID NO: 441, SEQ ID NO: 446, SEQ ID NO: 457, SEQ ID NO: 467, SEQ ID NO: 523, SEQ ID NO: 524, SEQ ID NO: 636, SEQ ID NO: 640, SEQ ID NO: 700, SEQ ID NO: 740, SEQ ID NO: 832, SEQ ID NO: 965, SEQ ID NO: 1015, SEQ ID NO: 1065, SEQ ID NO: 1071, SEQ ID NO: 1155, SEQ ID NO: 1475, SEQ ID NO: 1508, SEQ ID NO: 1685, SEQ ID NO: 1686, SEQ ID NO: 1687, SEQ ID NO: 1688, and SEQ ID NO: 1690.

In some embodiments, the ASOs of the disclosure bind to the target nucleic acid sequence (e.g., CAMK2D transcript) and are capable of inhibiting or reducing expression of the CAMK2D transcript by at least 10% or 20% compared to the normal (i.e., control) expression level in the cell, e.g., at least about 30%, at least about 40%, at least about 50%, at least about 60%, at least about 70%, at least about 80%, at least about 90%, at least about 95%, at least about 96%, at least about 97%, at least about 98%, at least about 99%, or about 100% compared to the normal expression level (e.g., expression level in cells that have not been exposed to the ASO).

In some embodiments, the ASOs of the disclosure are capable of reducing expression of CAMK2D mRNA in vitro by at least about 20%, at least about 30%, at least about 40%, at least about 50%, at least about 60%, at least about 70%, at least about 80%, at least about 90%, at least about 95%, at least about 96%, at least about 97%, at least about 98%, at least about 99%, or about 100% in HEK293 cells when the cells are in contact with 25 µM of the ASO compared to HEK293 cells that are not in contact with the ASO (e.g., contact with saline).

In some embodiments, the ASOs of the disclosure are capable of reducing expression of CAMK2D mRNA in vitro by at least about 20%, at least about 30%, at least about 40%, at least about 50%, at least about 60%, at least about 70%, at least about 80%, at least about 90%, at least about 95%, at least about 96%, at least about 97%, at least about 98%, at least about 99%, or about 100% in human inducible pluripotent stem cell-derived cardiomyocytes (hiPSC-CM) cells when the cells are in contact with 500 nM of the ASO compared to hiPSC-CM cells that are not in contact with the ASO (e.g., contact with saline).

In certain embodiments, the ASO of the disclosure has at least one property selected from the group consisting of: (i) reducing an mRNA level encoding CAMK2D in Inducible Pluripotent Stem Cell-Derived Cardiomyocytes (hiPSC- CM); (ii) reducing a protein level of CAMK2D in hiPSC-CM; (iii) reducing, ameliorating, or treating one or more symptoms of a cardiovascular disease or disorder, and (iv) any combination thereof.

In some embodiments, the ASO can tolerate 1, 2, 3, or 4 (or more) mismatches, when hybridizing to the target sequence and still sufficiently bind to the target to show the desired effect, i.e., down-regulation of the target mRNA and/or protein. Mismatches can, for example, be compensated by increased length of the ASO nucleotide sequence and/or an increased number of nucleotide analogs, which are disclosed elsewhere herein.

In some embodiments, the ASO of the disclosure comprises no more than 3 mismatches when hybridizing to the target sequence. In other embodiments, the contiguous nucleotide sequence comprises no more than 2 mismatches when hybridizing to the target sequence. In other embodiments, the contiguous nucleotide sequence comprises no more than 1 mismatch when hybridizing to the target sequence.

II.C. ASO Length

The ASOs can comprise a contiguous nucleotide sequence of a total of 10, 11, 12, 13, 14, 15, 16, 17, 18, 19, 20, 21, 22, 23, 24, 25, 26, 27, 28, 29, or 30 contiguous nucleotides in length. It should be understood that when a range is given for an ASO, or contiguous nucleotide sequence length, the range includes the lower and upper lengths provided in the range, for example from (or between) 10-30, includes both 10 and 30.

In some embodiments, the ASOs comprise a contiguous nucleotide sequence of a total of about 14-20, 14, 15, 16, 17, 18, 19, or 20 contiguous nucleotides in length.

II.D. Nucleosides and Nucleoside Analogs

In one aspect of the disclosure, the ASOs comprise one or more non-naturally occurring nucleoside analogs. "Nucleoside analogs" as used herein are variants of natural nucleosides, such as DNA or RNA nucleosides, by virtue of modifications in the sugar and/or base moieties. Analogs could in principle be merely "silent" or "equivalent" to the natural nucleosides in the context of the oligonucleotide, i.e. have no functional effect on the way the oligonucleotide works to inhibit target gene expression. Such "equivalent" analogs can nevertheless be useful if, for example, they are easier or cheaper to manufacture, or are more stable to storage or manufacturing conditions, or represent a tag or label. In some embodiments, however, the analogs will have a functional effect on the way in which the ASO works to inhibit expression; for example by producing increased binding affinity to the target and/or increased resistance to intracellular nucleases and/or increased ease of transport into the cell. Specific examples of nucleoside analogs are described by e.g. Freier & Altmann; *Nucl. Acid Res.*, 1997, 25, 4429-4443 and Uhlmann; *Curr. Opinion in Drug Development*, 2000, 3(2), 293-213, and in Scheme 1. The ASOs of the present disclosure can contain more than one, more than two, more than three, more than four, more than five, more than six, more than seven, more than eight, more than nine, more than 10, more than 11, more than 12, more than 13, more than 14, more than 15, more than 16, more than 18, more than 19, or more than 20 nucleoside analogs. In some embodiments, the nucleoside analogs in the ASOs are the same. In other embodiments, the nucleoside analogs in the ASOs are different. The nucleotide analogs in the ASOs can be any one of or combination of the following nucleoside analogs.

II.D.1. Nucleobase

The term nucleobase includes the purine (e.g., adenine and guanine) and pyrimidine (e.g., uracil, thymine and cytosine) moiety present in nucleosides and nucleotides which form hydrogen bonds in nucleic acid hybridization. In the context of the present disclosure, the term nucleobase also encompasses modified nucleobases which may differ from naturally occurring nucleobases, but are functional during nucleic acid hybridization. In some embodiments, the nucleobase moiety is modified by modifying or replacing the nucleobase. In this context, "nucleobase" refers to both naturally occurring nucleobases such as adenine, guanine, cytosine, thymidine, uracil, xanthine and hypoxanthine, as well as non-naturally occurring variants. Such variants are for example described in Hirao et al., (2012) *Accounts of Chemical Research* vol 45 page 2055 and Bergstrom (2009) Current Protocols in Nucleic Acid Chemistry Suppl. 37 1.4.1.

In a some embodiments, the nucleobase moiety is modified by changing the purine or pyrimidine into a modified purine or pyrimidine, such as substituted purine or substituted pyrimidine, such as a nucleobase selected from isocytosine, pseudoisocytosine, 5-methyl-cytosine, 5-thiozolo-cytosine, 5-propynyl-cytosine, 5-propynyl-uracil, 5-bromouracil, 5-thiazolo-uracil, 2-thio-uracil, 2'thio-thymine, inosine, diaminopurine, 6-aminopurine, 2-aminopurine, 2,6-diaminopurine, and 2-chloro-6-aminopurine.

The nucleobase moieties may be indicated by the letter code for each corresponding nucleobase, e.g., A, T, G, C, or U, wherein each letter may optionally include modified nucleobases of equivalent function. For example, in the exemplified oligonucleotides, the nucleobase moieties are selected from A, T, G, C, and 5-methyl-cytosine. Optionally, for LNA gapmers, 5-methyl-cytosine LNA nucleosides may be used.

II. D. 2. Sugar Modification

The ASO of the disclosure can comprise one or more nucleosides which have a modified sugar moiety, i.e. a modification of the sugar moiety when compared to the ribose sugar moiety found in DNA and RNA. Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradical bridge between the C2' and C4' carbons on the ribose ring (LNA), or an unlinked ribose ring which typically lacks a bond between the C2' and C3' carbons (e.g., UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'-OH group naturally found in RNA nucleosides. Substituents may, for example be introduced at the 2',3',4', or 5' positions. Nucleosides with modified sugar moieties also include 2' modified nucleosides, such as 2' substituted nucleosides. Indeed, much focus has been spent on developing 2' substituted nucleosides, and numerous 2' substituted nucleosides have been found to have beneficial properties when incorporated into oligonucleotides, such as enhanced nucleoside resistance and enhanced affinity.

II.D.2.a 2' Modified Nucleosides

A 2' sugar modified nucleoside is a nucleoside which has a substituent other than H or —OH at the 2' position (2' substituted nucleoside) or comprises a 2' linked biradical, and includes 2' substituted nucleosides and LNA (2'-4' biradical bridged) nucleosides. For example, the 2' modified sugar may provide enhanced binding affinity (e.g., affinity enhancing 2' sugar modified nucleoside) and/or increased nuclease resistance to the oligonucleotide. Examples of 2' substituted modified nucleosides are 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, 2'-Fluro-DNA, arabino nucleic acids (ANA), and 2'-Fluoro-ANA nucleoside. For further examples, please see, e.g., Freier & Altmann; *Nucl. Acid Res.*, 1997, 25, 4429-4443; Uhlmann, *Curr. Opinion in Drug Development*, 2000, 3(2), 293-213; and Deleavey and Damha, Chemistry and Biology 2012, 19, 937. Below are illustrations of some 2' substituted modified nucleosides.

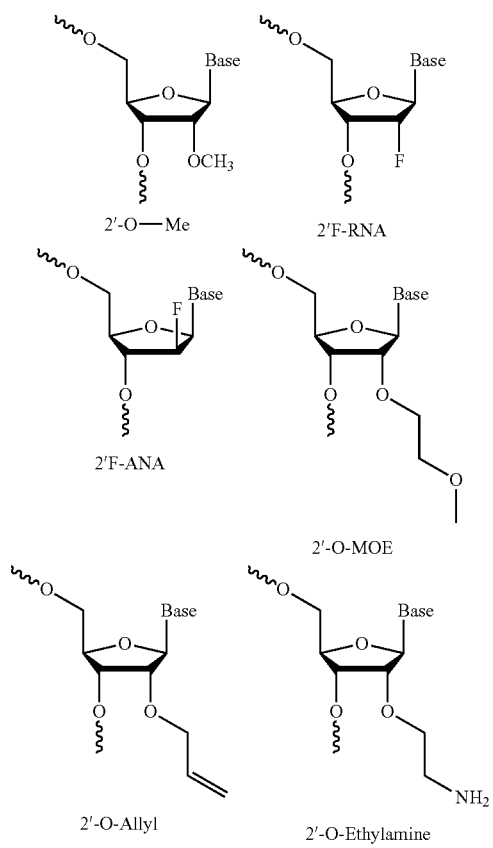

2'-O—Me
2'F-RNA
2'F-ANA
2'-O-MOE
2'-O-Allyl
2'-O-Ethylamine

II.D.2.b Locked Nucleic Acid Nucleosides (LNA).

LNA nucleosides are 2'-sugar modified nucleosides which comprise a linker group (referred to as a biradical or a bridge) between C2' and C4' of the ribose sugar ring of a nucleoside (i.e., 2'-4' bridge), which restricts or locks the conformation of the ribose ring. These nucleosides are also termed bridged nucleic acid or bicyclic nucleic acid (BNA) in the literature. The locking of the conformation of the ribose is associated with an enhanced affinity of hybridization (duplex stabilization) when the LNA is incorporated into an oligonucleotide for a complementary RNA or DNA molecule. This can be routinely determined by measuring the melting temperature of the oligonucleotide/complement duplex.

Non limiting, exemplary LNA nucleosides are disclosed in WO 99/014226, WO 00/66604, WO 98/039352, WO 2004/046160, WO 00/047599, WO 2007/134181, WO 2010/077578, WO 2010/036698, WO 2007/090071, WO 2009/006478, WO 2011/156202, WO 2008/154401, WO 2009/067647, WO 2008/150729, Morita et al., *Bioorganic & Med. Chem. Lett.* 12, 73-76, Seth et al., *J. Org. Chem.* 2010, Vol 75(5) pp. 1569-81, and Mitsuoka et al., *Nucleic Acids Research* 2009, 37(4), 1225-1238.

The 2'-4' bridge comprises 1 to 4 bridging atoms and is in particular of formula —X—Y— wherein X is oxygen, sulfur, —CR$^a$R$^b$—, —C(R$^a$)=C(R$^b$), —C(=CR$^a$R$^b$)—, —C(R$^a$)=N, —Si(R$^a$)2-, —SO2-, —NR$^a$—; —O—NR$^a$—, —NR$^a$—O—, >C=J, Se; -cPr—, —O—NR$^a$—, NR$^a$—CR$^a$R$^b$—, —N(R$^a$)—O—, or —O—CR$^a$R$^b$—;

Y is oxygen, sulfur, —(CR$^a$R$^b$)—CR$^a$R$^b$—O—CR$^a$R$^b$—, —C(R$^a$)=C(R$^b$), —C(R$^a$)=N, —Si(R$^a$)2-, —SO2-, —NR$^a$—, or >C=J Se; -cPr—, —O—NR$^a$—, —O—CR$^a$R$^b$—, or NR$^a$—CR$^a$R$^b$—; wherein n is 1 or 2;

with the proviso that —X—Y— is not —O—O—, Si(R$^a$)$_2$ —Si(R$^a$)$_2$—, —SO$_2$—SO$_2$—, —C(R$^a$)=C(R$^b$)—C(R$^a$)=C(R$^b$), —C(R$^a$)=N—C(R$^a$)=N—, —C(R$^a$)=N—C(R$^a$)=C(R$^b$), —C(R$^a$)=C(R$^b$)—C(R$^a$)=N—, or —Se—Se—;

J is oxygen, sulfur, CH$_2$, or =N(R$^a$);

R$^a$ and R$^b$ are independently selected from hydrogen, halogen, hydroxyl, cyano, thiohydroxyl, optionally substituted alkyl, optionally substituted alkenyl, optionally substituted alkynyl, optionally substituted alkoxy, alkoxyalkyl, alkenyloxy, carboxyl, alkoxycarbonyl, alkylcarbonyl, formyl, aryl, heterocycle, amino, alkylamino, carbamoyl, alkylaminocarbonyl, aminoalkylaminocarbonyl, alkylaminoalkylaminocarbonyl, alkylcarbonylamino, carbamido, alkanoyloxy, sulfone alkylsulfonyloxy, nitro, azido, thiol-sulfidealkylsulfanyl, aryloxycarbonyl, aryloxy, arylcarbonyl, heteroaryl, heteroaryloxycarbonyl, heteroaryloxy, heteroarylcarbonyl, —OC(=X$^a$)R$^c$, —OC(=X$^a$)NR$^c$R$^d$ and —NR$^e$C(=X$^a$)NR$^c$R$^d$; or two geminal R$^a$ and R$^b$ together form optionally substituted methylene; wherein substituted alkyl, substituted alkenyl, substituted alkynyl, substituted alkoxy and substituted methylene are alkyl, alkenyl, alkynyl and methylene substituted with 1 to 3 substituents independently selected from halogen, hydroxyl, alkyl, alkenyl, alkynyl, alkoxy, alkoxyalkyl, alkenyloxy, carboxyl, alkoxycarbonyl, alkylcarbonyl, formyl, heterocycle, aryl, and heteroaryl;

X$^a$ is oxygen, sulfur or —NRc;

R$^c$, R$^d$, and R$^e$ are independently hydrogen or alkyl; and n is 1, 2 or 3.

In some embodiments, X is oxygen, sulfur, —NR$^a$—, —CR$^a$R$^b$— or —C(=CR$^a$R$^b$)—, particularly oxygen, sulfur, —NH—, —CH$_2$— or —C(=CH$_2$)—, more particularly oxygen.

In some embodiments, Y is —CR$^a$R$^b$—, —CR$^a$R$^b$—CR$^a$R$^b$— or —CR$^a$R$^b$—CR$^a$R$^b$—CR$^a$R$^b$—, particularly —CH$_2$—CHCH$_3$—, —CHCH$_3$—CH$_2$—, CH$_2$—CH$_2$— or —CH$_2$—CH$_2$—CH$_2$—.

In some embodiments, —X—Y— is —O—(CR$^a$R$^b$)$_n$—, —S—CR$^a$R$^b$—, —CR$^a$R$^b$—CR$^a$R$^b$—, —O—CR$^a$R$^b$—O—CR$^a$R$^b$—, —CR$^a$R$^b$—O—CR$^a$R$^b$—, —C(=CR$^a$R$^b$)—CR$^a$R$^b$—, —O—N(R$^a$)CR$^a$R$^b$—, or —N(R$^a$)—O—CR$^a$R$^b$—.

In some embodiments, $R^a$ and $R^b$ are independently selected from the group consisting of hydrogen, halogen, hydroxyl, alkyl and alkoxyalkyl, in particular, hydrogen, alkyl and alkoxyalkyl.

In some embodiments, $R^a$ and $R^b$ are independently selected from the group consisting of hydrogen, halogen, such as fluoro, hydroxyl, methyl and —CH$_2$—O—CH$_3$, in particular, hydrogen, methyl and —CH$_2$—O—CH$_3$.

In some embodiments, $R^a$ is hydrogen or alkyl, in particular, hydrogen or methyl.

In some embodiments, $R^b$ is hydrogen or alkyl, in particular hydrogen or methyl. In some embodiments, one or both of $R^a$ and $R^b$ are hydrogen. In certain embodiments, only one of $R^a$ and $R^b$ is hydrogen. In some embodiments, one of $R^a$ and $R^b$ is methyl and the other one is hydrogen. In other embodiments, $R^a$ and $R^b$ are both methyl at the same time.

In a particular embodiment of the invention, —X—Y— is —O—CH$_2$—, —S—CH$_2$—, —S—CH(CH$_3$)—, —NH—CH$_2$—, —O—CH$_2$CH$_2$—, —O—CH(CH$_2$—O—CH$_3$)—, —O—CH(CH$_2$CH$_3$)—, —O—CH(CH$_3$)—, —O—CH$_2$—O—CH$_2$—, —O—CH$_2$—O—CH$_2$—, —CH$_2$—O—CH$_2$—, —C(=CH$_2$)CH$_2$—, —C(=CH$_2$)CH(CH$_3$)—, —N(—O—CH$_3$)— or —N(CH$_3$)—;

In some embodiments, —X—Y— is —O—CR$^a$R$^b$— wherein $R^a$ and $R^b$ are independently selected from the group consisting of hydrogen, alkyl and alkoxyalkyl, in particular, hydrogen, methyl and —CH$_2$—O—CH$_3$.

In some embodiments, —X—Y— is —O—CH$_2$— or —O—CH(CH$_3$)—, particularly —O—CH$_2$—.

The 2'-4' bridge can be positioned either below the plane of the ribose ring (beta-D-configuration), or above the plane of the ring (alpha-L-configuration), as illustrated in formula (A) and formula (B) respectively.

In some embodiments, the modified nucleoside or the LNA nucleosides of the ASO of the disclosure has a general structure of the formula II or III:

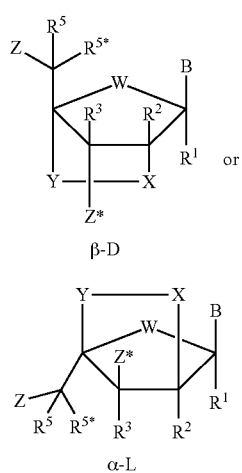

Formula II

β-D

Formula III

α-L wherein
W is selected from —O—, —S—, —N(R$^a$)—, —C(R$^a$R$^b$)—, in particular O—;
B is a nucleobase or a modified nucleobase moiety;
Z is an internucleoside linkage to an adjacent nucleoside or a 5'-terminal group;
Z* is an internucleoside linkage to an adjacent nucleoside or a 3'-terminal group;
$R^1$, $R^2$, $R^3$, $R^5$ and $R^{5*}$ are independently selected from hydrogen, halogen, alkyl, alkenyl, alkynyl, hydroxy, alkoxy, alkoxyalkyl, alkenyloxy, carboxyl, alkoxycarbonyl, alkylcarbonyl, formyl, azide, heterocycle and aryl; and
X, Y, $R^a$ and $R^b$ are as defined herein.

In some embodiments, —X—Y—, $R^a$ is hydrogen or alkyl, in particular hydrogen or methyl. In some embodiments of —X—Y—, $R^b$ is hydrogen or alkyl, in particular hydrogen or methyl. In other embodiments of —X—Y—, one or both of $R^a$ and $R^b$ are hydrogen. In further embodiments of —X—Y—, only one of $R^a$ and $R^b$ is hydrogen. In some embodiments of —X—Y—, one of $R^a$ and $R^b$ is methyl and the other one is hydrogen. In certain embodiments of —X—Y—, $R^a$ and $R^b$ are both methyl at the same time.

In some embodiments, —X—, $R^a$ is hydrogen or alkyl, in particular hydrogen or methyl. In some embodiments of —X—, $R^b$ is hydrogen or alkyl, in particular hydrogen or methyl. In other embodiments of —X—, one or both of $R^a$ and $R^b$ are hydrogen. In certain embodiments of —X—, only one of $R^a$ and $R^b$ is hydrogen. In certain embodiments of —X—, one of $R^a$ and $R^b$ is methyl and the other one is hydrogen. In other embodiments of —X—, $R^a$ and $R^b$ are both methyl at the same time.

In some embodiments, —Y—, $R^a$ is hydrogen or alkyl, in particular hydrogen or methyl. In certain embodiments of —Y—, $R^b$ is hydrogen or alkyl, in particular hydrogen or methyl. In other embodiments of —Y—, one or both of $R^a$ and $R^b$ are hydrogen. In some embodiments of —Y—, only one of $R^a$ and $R^b$ is hydrogen. In other embodiments of —Y—, one of $R^a$ and $R^b$ is methyl and the other one is hydrogen. In some embodiments of —Y—, $R^a$ and $R^b$ are both methyl at the same time.

In some embodiments, $R^1$, $R^2$, $R^3$, $R^5$ and $R^{5*}$ are independently selected from hydrogen and alkyl, in particular hydrogen and methyl.

In some embodiments, $R^1$, $R^2$, $R^3$, $R^5$ and $R^{5*}$ are all hydrogen at the same time.

In some embodiments, $R^1$, $R^2$, $R^3$, are all hydrogen at the same time, one of $R^5$ and $R^{5*}$ is hydrogen and the other one is as defined above, in particular alkyl, more particularly methyl.

In some embodiments, $R^1$, $R^2$, $R^3$, are all hydrogen at the same time, one of $R^5$ and $R^{5*}$ is hydrogen and the other one is azide.

In some embodiments, —X—Y— is —O—CH$_2$—, W is oxygen and $R^1$, $R^2$, $R^3$, $R^5$ and $R^{5*}$ are all hydrogen at the same time. Such LNA nucleosides are disclosed in WO 99/014226, WO 00/66604, WO 98/039352 and WO 2004/046160, which are all hereby incorporated by reference, and include what are commonly known in the art as beta-D-oxy LNA and alpha-L-oxy LNA nucleosides.

In some embodiments, —X—Y— is —S—CH$_2$—, W is oxygen and $R^1$, $R^2$, $R^3$, $R^5$ and $R^{5*}$ are all hydrogen at the same time. Such thio LNA nucleosides are disclosed in WO 99/014226 and WO 2004/046160 which are hereby incorporated by reference.

In some embodiments, —X—Y— is —NH—CH$_2$—, W is oxygen and $R^1$, $R^2$, $R^3$, $R^5$ and $R^{5*}$ are all hydrogen at the same time. Such amino LNA nucleosides are disclosed in WO 99/014226 and WO 2004/046160, which are hereby incorporated by reference.

In some embodiments, —X—Y— is —O—CH$_2$CH$_2$— or —OCH$_2$CH$_2$CH$_2$—, W is oxygen, and $R^1$, $R^2$, $R^3$, $R^5$ and $R^{5*}$ are all hydrogen at the same time. Such LNA nucleosides are disclosed in WO 00/047599 and Morita et al., Bioorganic & Med. Chem. Lett. 12, 73-76, which are hereby incorporated by reference, and include what are commonly known in the art as 2'-O-4'C-ethylene bridged nucleic acids (ENA).

In some embodiments, —X—Y— is —O—CH$_2$—, W is oxygen, $R^1$, $R^2$, $R^3$ are all hydrogen at the same time, one of $R^5$ and $R^{5*}$ is hydrogen and the other one is not hydrogen, such as alkyl, for example methyl. Such 5' substituted LNA nucleosides are disclosed in WO 2007/134181, which is hereby incorporated by reference.

In some embodiments, —X—Y— is —O—CR$^a$R$^b$—, wherein one or both of R$^a$ and R$^b$ are not hydrogen, in particular alkyl such as methyl, W is oxygen, $R^1$, $R^2$, $R^3$ are all hydrogen at the same time, one of $R^5$ and $R^{5*}$ is hydrogen and the other one is not hydrogen, in particular alkyl, for example methyl. Such bis modified LNA nucleosides are disclosed in WO 2010/077578, which is hereby incorporated by reference.

In some embodiments, —X—Y— is —O—CH(CH$_2$—O—CH$_3$)— ("2' O-methoxyethyl bicyclic nucleic acid", Seth et al., J. Org. Chem. 2010, Vol 75(5) pp. 1569-81).

In some embodiments, —X—Y— is —O—CHR$^a$—, W is oxygen and $R^1$, $R^2$, $R^3$, $R^5$ and $R^{5*}$ are all hydrogen at the same time. Such 6'-substituted LNA nucleosides are disclosed in WO 2010/036698 and WO 2007/090071, which are both hereby incorporated by reference. In such 6'-substituted LNA nucleosides, R$^a$ is in particular C1-C6 alkyl, such as methyl.

In some embodiments, —X—Y— is —O—CH(CH$_2$—O—CH$_3$)—, W is oxygen and $R^1$, $R^2$, $R^3$, $R^5$ and $R^{5*}$ are all hydrogen at the same time. Such LNA nucleosides are also known in the art as cyclic MOEs (cMOE) and are disclosed in WO 2007/090071.

In some embodiments, —X—Y— is —O—CH(CH$_3$)—.

In some embodiments, —X—Y— is —O—CH$_2$—O—CH$_2$— (Seth et al., J. Org. Chem 2010 op. cit.)

In some embodiments, —X—Y— is —O—CH(CH$_3$)—, W is oxygen and $R^1$, $R^2$, $R^3$, $R^5$ and $R^{5*}$ are all hydrogen at the same time. Such 6'-methyl LNA nucleosides are also known in the art as cET nucleosides, and may be either (S)-cET or (R)-cET diastereoisomers, as disclosed in WO 2007/090071 (beta-D) and WO 2010/036698 (alpha-L) which are both hereby incorporated by reference.

In some embodiments, —X—Y— is —O—CR$^a$R$^b$—, wherein neither R$^a$ nor R$^b$ is hydrogen, W is oxygen, and $R^1$, $R^2$, $R^3$, $R^5$ and $R^{5*}$ are all hydrogen at the same time. In certain embodiments, R$^a$ and R$^b$ are both alkyl at the same time, in particular both methyl at the same time. Such 6'-di-substituted LNA nucleosides are disclosed in WO 2009/006478 which is hereby incorporated by reference.

In some embodiments, —X—Y— is —S—CHR$^a$—, W is oxygen, and $R^1$, $R^2$, $R^3$, $R^5$ and $R^{5*}$ are all hydrogen at the same time. Such 6'-substituted thio LNA nucleosides are disclosed in WO 2011/156202, which is hereby incorporated by reference. In certain embodiments of such 6'-substituted thio LNA, R$^a$ is alkyl, in particular methyl.

In some embodiments, —X—Y— is —C(=CH$_2$)C(R$^a$R$^b$)—, such as, W is oxygen, and $R^1$, $R^2$, $R^3$, $R^5$ and $R^{5*}$ are all hydrogen at the same time. Such vinyl carbo LNA nucleosides are disclosed in WO 2008/154401 and WO 2009/067647, which are both hereby incorporated by reference.

In some embodiments, —X—Y— is —N(OR$^a$)—CH$_2$—, W is oxygen and $R^1$, $R^2$, $R^3$, $R^5$ and $R^{5*}$ are all hydrogen at the same time. In some embodiments, R$^a$ is alkyl such as methyl. Such LNA nucleosides are also known as N substituted LNAs and are disclosed in WO 2008/150729, which is hereby incorporated by reference.

In some embodiments, —X—Y— is —O—NCH$_3$— (Seth et al., J. Org. Chem 2010 op. cit.).

In some embodiments, —X—Y— is ON(R$^a$)—N(R$^a$)—O—, —NR$^a$—CR$^a$R$^b$—CR$^a$R$^b$—, or —NR$^a$—CR$^a$R$^b$—, W is oxygen, and $R^1$, $R^2$, $R^3$, $R^5$ and $R^{5*}$ are all hydrogen at the same time. In certain embodiments, R$^a$ is alkyl, such as methyl. (Seth et al., —J. Org. Chem 2010 op. cit.).

In some embodiments, $R^5$ and $R^{5*}$ are both hydrogen at the same time. In other embodiments, one of $R^5$ and $R^{5*}$ is hydrogen and the other one is alkyl, such as methyl. In such embodiments, $R^1$, $R^2$ and $R^3$ can be in particular hydrogen and —X—Y— can be in particular —O—CH$_2$— or —O—CHC(R$^a$)$_3$—, such as —O—CH(CH$_3$)—.

In some embodiments, —X—Y— is —CR$^a$R$^b$—O—CR$^a$R$^b$—, such as —CH$_2$—O—CH$_2$—, W is oxygen and $R^1$, $R^2$, $R^3$, $R^5$ and $R^{5*}$ are all hydrogen at the same time. In such embodiments, R$^a$ can be in particular alkyl such as methyl. Such LNA nucleosides are also known as conformationally restricted nucleotides (CRNs) and are disclosed in WO 2013/036868, which is hereby incorporated by reference.

In some embodiments, —X—Y— is —O—CR$^a$R$^b$—O—CR$^a$R$^b$—, such as —O—CH$_2$—O—CH$_2$—, W is oxygen and $R^1$, $R^2$, $R^3$, $R^5$ and $R^{5*}$ are all hydrogen at the same time. In certain embodiments, R$^a$ can be in particular alkyl such as methyl. Such LNA nucleosides are also known as COC nucleotides and are disclosed in Mitsuoka et al., Nucleic Acids Research 2009, 37(4), 1225-1238, which is hereby incorporated by reference.

It will be recognized than, unless specified, the LNA nucleosides may be in the beta-D or alpha-L stereoisoform.

Certain examples of LNA nucleosides are presented in Scheme 1.

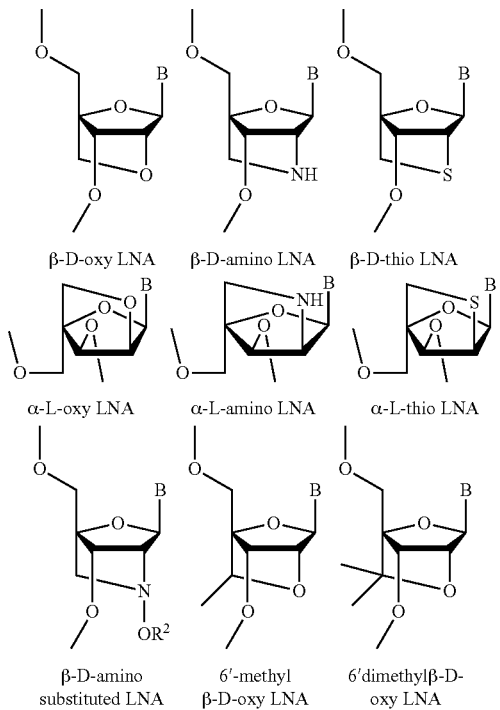

Scheme 1

β-D-oxy LNA    β-D-amino LNA    β-D-thio LNA

α-L-oxy LNA    α-L-amino LNA    α-L-thio LNA

β-D-amino substituted LNA    6'-methyl β-D-oxy LNA    6'dimethylβ-D-oxy LNA

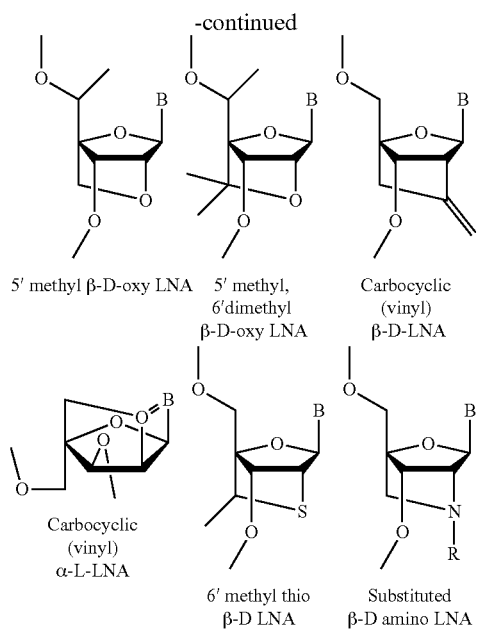

5′ methyl β-D-oxy LNA  5′ methyl, 6′dimethyl β-D-oxy LNA  Carbocyclic (vinyl) β-D-LNA Carbocyclic (vinyl) α-L-LNA  6′ methyl thio β-D LNA  Substituted β-D amino LNA As illustrated elsewhere, in some embodiments of the disclosure the LNA nucleosides in the oligonucleotides are beta-D-oxy-LNA nucleosides.

II.E. Nuclease Mediated Degradation

Nuclease mediated degradation refers to an oligonucleotide capable of mediating degradation of a complementary nucleotide sequence when forming a duplex with such a sequence.

In some embodiments, the oligonucleotide may function via nuclease mediated degradation of the target nucleic acid, where the oligonucleotides of the disclosure are capable of recruiting a nuclease, particularly and endonuclease, preferably endoribonuclease (RNase), such as RNase H. Examples of oligonucleotide designs which operate via nuclease mediated mechanisms are oligonucleotides which typically comprise a region of at least 5 or 6 DNA nucleosides and are flanked on one side or both sides by affinity enhancing nucleosides, for example gapmers, headmers and tailmers.

II.F. RNase H Activity and Recruitment

The RNase H activity of an antisense oligonucleotide refers to its ability to recruit RNase H when in a duplex with a complementary RNA molecule and induce degradation of the complementary RNA molecule. WO01/23613 provides in vitro methods for determining RNaseH activity, which may be used to determine the ability to recruit RNaseH. Typically, an oligonucleotide is deemed capable of recruiting RNase H if, when provided with a complementary target nucleic acid sequence, it has an initial rate, as measured in pmol/l/min, of at least 5%, such as at least 10% or more than 20% of the of the initial rate determined when using a oligonucleotide having the same base sequence as the modified oligonucleotide being tested, but containing only DNA monomers, with phosphorothioate linkages between all monomers in the oligonucleotide, and using the methodology provided by Example 91-95 of WO01/23613.

In some embodiments, an oligonucleotide is deemed essentially incapable of recruiting RNaseH if, when provided with the complementary target nucleic acid, the RNaseH initial rate, as measured in pmol/l/min, is less than 20%, such as less than 10%, such as less than 5% of the initial rate determined when using a oligonucleotide having the same base sequence as the oligonucleotide being tested, but containing only DNA monomers, with no 2′ substitutions, with phosphorothioate linkages between all monomers in the oligonucleotide, and using the methodology provided by Example 91-95 of WO01/23613.

II.G. ASO Design

The ASO of the disclosure can comprise a nucleotide sequence which comprises both nucleosides and nucleoside analogs, and can be in the form of a gapmer, blockmer, mixmer, headmer, tailmer, or totalmer. Examples of configurations of a gapmer, blockmer, mixmer, headmer, tailmer, or totalmer that can be used with the ASO of the disclosure are described in U.S. Patent Appl. Publ. No. 2012/0322851.

The term "gapmer" as used herein refers to an antisense oligonucleotide which comprises a region of RNase H recruiting oligonucleotides (gap) which is flanked 5′ and 3′ by one or more affinity enhancing modified nucleosides (flanks). The terms "headmers" and "tailmers" are oligonucleotides capable of recruiting RNase H where one of the flanks is missing, i.e., only one of the ends of the oligonucleotide comprises affinity enhancing modified nucleosides. For headmers, the 3′ flank is missing (i.e., the 5′ flank comprise affinity enhancing modified nucleosides) and for tailmers, the 5′ flank is missing (i.e., the 3′ flank comprises affinity enhancing modified nucleosides). The term "LNA gapmer" is a gapmer oligonucleotide wherein at least one of the affinity enhancing modified nucleosides is an LNA nucleoside. The term "mixed wing gapmer" refers to an LNA gapmer wherein the flank regions comprise at least one LNA nucleoside and at least one DNA nucleoside or non-LNA modified nucleoside, such as at least one 2′ substituted modified nucleoside, such as, for example, 2′-O-alkyl-RNA, 2′-O-methyl-RNA, 2′-alkoxy-RNA, 2′-O-methoxyethyl-RNA (MOE), 2′-amino-DNA, 2′-Fluoro-RNA, 2′-Fluro-DNA, arabino nucleic acid (ANA), and 2′-Fluoro-ANA nucleoside(s).

Other "chimeric" ASOs, called "mixmers", consist of an alternating composition of (i) DNA monomers or nucleoside analog monomers recognizable and cleavable by RNase, and (ii) non-RNase recruiting nucleoside analog monomers.

A "totalmer" is a single stranded ASO which only comprises non-naturally occurring nucleotides or nucleotide analogs.

In some embodiments, in addition to enhancing affinity of the ASO for the target region, some nucleoside analogs also mediate RNase (e.g., RNaseH) binding and cleavage. Since α-L-LNA monomers recruit RNaseH activity to a certain extent, in some embodiments, gap regions (e.g., region B as referred to herein) of ASOs containing α-L-LNA monomers consist of fewer monomers recognizable and cleavable by the RNaseH, and more flexibility in the mixmer construction is introduced.

II.G.1. Gapmer Design

In some embodiments, the ASO of the disclosure is a gapmer and comprises a contiguous stretch of nucleotides (e.g., one or more DNA) which is capable of recruiting an RNase, such as RNaseH, referred to herein in as region B (B), wherein region B is flanked at both 5′ and 3′ by regions of nucleoside analogs 5′ and 3′ to the contiguous stretch of nucleotides of region B—these regions are referred to as regions A (A) and C (C), respectively. In some embodiments, the nucleoside analogs are sugar modified nucleosides (e.g., high affinity sugar modified nucleosides). In certain embodiments, the sugar modified nucleosides of regions A and C enhance the affinity of the ASO for the target nucleic acid (i.e., affinity enhancing 2' sugar modified nucleosides). In some embodiments, the sugar modified nucleosides are 2' sugar modified nucleosides, such as high affinity 2' sugar modifications, such as LNA or 2'-MOE.

In a gapmer, the 5' and 3' most nucleosides of region B are DNA nucleosides, and are positioned adjacent to nucleoside analogs (e.g., high affinity sugar modified nucleosides) of regions A and C, respectively. In some embodiments, regions A and C can be further defined by having nucleoside analogs at the end most distant from region B (i.e., at the 5' end of region A and at the 3' end of region C).

In some embodiments, the ASOs of the present disclosure comprise a nucleotide sequence of formula (5' to 3') A-B-C, wherein: (A) (5' region or a first wing sequence) comprises at least one nucleoside analog (e.g., 3-5 LNA units); (B) comprises at least four consecutive nucleosides (e.g., 4-24 DNA units), which are capable of recruiting RNase (when formed in a duplex with a complementary RNA molecule, such as the pre-mRNA or mRNA target); and (C) (3' region or a second wing sequence) comprises at least one nucleoside analog (e.g., 3-5 LNA units).

In some embodiments, region A comprises 3-5 nucleotide analogs, such as LNA, region B consists of 6-24 (e.g., 6, 7, 8, 9, 10, 11, 12, 13, or 14) DNA units, and region C consists of 3 or 4 nucleotide analogs, such as LNA. Such designs include (A-B-C) 3-14-3, 3-11-3, 3-12-3, 3-13-3, 4-9-4, 4-10-4, 4-11-4, 4-12-4, and 5-10-5. In some embodiments, the ASO has a design of LLLD$_n$LLL, LLLLD$_n$LLLL, or LLLLLD$_n$LLLLL, wherein the L is a nucleoside analog, the D is DNA, and n can be any integer between 4 and 24. In some embodiments, n can be any integer between 6 and 14. In some embodiments, n can be any integer between 8 and 12.

Further gapmer designs are disclosed in WO2004/046160, WO 2007/146511, and WO2008/113832, each of which is hereby incorporated by reference in its entirety.

II.H. Internucleotide Linkages

The monomers of the ASOs described herein are coupled together via linkage groups. Suitably, each monomer is linked to the 3' adjacent monomer via a linkage group.

The person having ordinary skill in the art would understand that, in the context of the present disclosure, the 5' monomer at the end of an ASO does not comprise a 5' linkage group, although it may or may not comprise a 5' terminal group.

The terms "linkage group" or "internucleoside linkage" are intended to mean a group capable of covalently coupling together two nucleosides. Specific and preferred examples include phosphate groups and phosphorothioate groups.

The nucleosides of the ASO of the disclosure or contiguous nucleosides sequence thereof are coupled together via linkage groups. Suitably each nucleoside is linked to the 3' adjacent nucleoside via a linkage group.

In some embodiments, the internucleoside linkage is modified from its normal phosphodiester to one that is more resistant to nuclease attack, such as phosphorothioate, which is cleavable by RNaseH, also allows that route of antisense inhibition in reducing the expression of the target gene. In some embodiments, at least 75%, at least 80%, at least 85%, at least 90%, at least 91%, at least 92%, at least 93%, at least 94%, at least 95%, at least 96%, at least 97%, at least 98%, at least 99%, or 100% of internucleoside linkages are modified.

II.I. Conjugates

The term conjugate as used herein refers to an ASO which is covalently linked to a non-nucleotide moiety (conjugate moiety or region C or third region).

Conjugation of the ASO of the disclosure to one or more non-nucleotide moieties may improve the pharmacology of the ASO, e.g., by affecting the activity, cellular distribution, cellular uptake, or stability of the ASO. In some embodiments, the non-nucleotide moieties modify or enhance the pharmacokinetic properties of the ASO by improving cellular distribution, bioavailability, metabolism, excretion, permeability, and/or cellular uptake of the ASO. In certain embodiments, the non-nucleotide moieties may target the ASO to a specific organ, tissue, or cell type and thereby enhance the effectiveness of the ASO in that organ, tissue, or cell type. In other embodiments, the non-nucleotide moieties reduce the activity of the ASO in non-target cell types, tissues, or organs, e.g., off target activity or activity in non-target cell types, tissues, or organs. WO 93/07883 and WO2013/033230 provides suitable conjugate moieties. Further suitable conjugate moieties are those capable of binding to the asialoglycoprotein receptor (ASGPr). In particular, tri-valent N-acetylgalactosamine conjugate moieties are suitable for binding to the ASGPr, see, e.g., WO 2014/076196, WO 2014/207232, and WO 2014/179620, each of which are hereby incorporated by reference.

In some embodiments, the non-nucleotide moiety (conjugate moiety) is selected from the group consisting of carbohydrates, cell surface receptor ligands, drug substances, hormones, lipophilic substances, polymers, proteins, peptides, toxins (e.g., bacterial toxins), vitamins, viral proteins (e.g., capsids), and combinations thereof.

II.J. Activated ASOs

The term "activated ASO," as used herein, refers to an ASO that is covalently linked (i.e., functionalized) to at least one functional moiety that permits covalent linkage of the ASO to one or more conjugated moieties, i.e., moieties that are not themselves nucleic acids or monomers, to form the conjugates herein described. Typically, a functional moiety will comprise a chemical group that is capable of covalently bonding to the ASO via, e.g., a 3'-hydroxyl group or the exocyclic NH$_2$ group of the adenine base, a spacer that can be hydrophilic and a terminal group that is capable of binding to a conjugated moiety (e.g., an amino, sulfhydryl or hydroxyl group). In some embodiments, this terminal group is not protected, e.g., is an NH$_2$ group. In other embodiments, the terminal group is protected, for example, by any suitable protecting group such as those described in "Protective Groups in Organic Synthesis" by Theodora W Greene and Peter G M Wuts, 3rd edition (John Wiley & Sons, 1999), which is hereby incorporated by reference.

In some embodiments, ASOs of the disclosure are functionalized at the 5' end in order to allow covalent attachment of the conjugated moiety to the 5' end of the ASO. In other embodiments, ASOs of the disclosure can be functionalized at the 3' end. In still other embodiments, ASOs of the disclosure can be functionalized along the backbone or on the heterocyclic base moiety. In yet other embodiments, ASOs of the disclosure can be functionalized at more than one position independently selected from the 5' end, the 3' end, the backbone and the base.

In some embodiments, activated ASOs of the disclosure are synthesized by incorporating during the synthesis one or more monomers that is covalently attached to a functional moiety. In other embodiments, activated ASOs of the disclosure are synthesized with monomers that have not been functionalized, and the ASO is functionalized upon completion of synthesis.

III. Pharmaceutical Compositions and Administration Routes

The ASO of the disclosure can be used in pharmaceutical formulations and compositions. In some embodiments, such compositions comprise a pharmaceutically acceptable diluent, carrier, salt, or adjuvant. In certain embodiments, a pharmaceutically acceptable salt comprises a sodium salt, a potassium salt, or an ammonium salt The ASO of the disclosure can be included in a unit formulation such as in a pharmaceutically acceptable carrier or diluent in an amount sufficient to deliver to a patient a therapeutically effective amount without causing serious side effects in the treated patient. However, in some forms of therapy, serious side effects may be acceptable in terms of ensuring a positive outcome to the therapeutic treatment.

The formulated drug may comprise pharmaceutically acceptable binding agents and adjuvants. Capsules, tablets, or pills can contain for example the following compounds: microcrystalline cellulose, gum or gelatin as binders; starch or lactose as excipients; stearates as lubricants; various sweetening or flavoring agents. For capsules, the dosage unit can contain a liquid carrier like fatty oils. Likewise, coatings of sugar or enteric agents can be part of the dosage unit. The ASO formulations can also be emulsions of the active pharmaceutical ingredients and a lipid forming a micellular emulsion.

The pharmaceutical compositions of the present disclosure can be administered in a number of ways depending upon whether local or systemic treatment is desired and upon the area to be treated. Administration can be (a) oral; (b) pulmonary, e.g., by inhalation or insufflation of powders or aerosols, including by nebulizer; intratracheal, intranasal, (c) topical including epidermal, transdermal, ophthalmic and to mucous membranes including vaginal and rectal delivery; or (d) parenteral including intravenous, intraarterial, subcutaneous, intraperitoneal or intramuscular injection or infusion; or intracranial, e.g., intrathecal, intra-cerebroventricular, or intraventricular, administration. In some embodiments, the ASO is administered intravenously, intraperitoneally, orally, topically, or as a bolus injection or administered directly in to the target organ. In some embodiments, the ASO is administered intracardially or intraventricularly as a bolus injection. In some embodiments, the ASO is administered subcutaneously. In some embodiments, the ASO is administered orally.

Pharmaceutical compositions and formulations for topical administration can include transdermal patches, ointments, lotions, creams, gels, drops, sprays, suppositories, liquids and powders. Conventional pharmaceutical carriers, aqueous, powder or oily bases, thickeners and the like may be necessary or desirable. Examples of topical formulations include those in which the ASO of the disclosure are in admixture with a topical delivery agent such as lipids, liposomes, fatty acids, fatty acid esters, steroids, chelating agents and surfactants. Compositions and formulations for oral administration include but are not limited to powders or granules, microparticulates, nanoparticulates, suspensions or solutions in water or non-aqueous media, capsules, gel capsules, sachets, tablets or minitablets. Compositions and formulations for parenteral, intrathecal, intra-cerebroventricular, or intraventricular administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions may be generated from a variety of components that include, but are not limited to, preformed liquids, self-emulsifying solids and self-emulsifying semisolids. Delivery of drug to the target tissue can be enhanced by carrier-mediated delivery including, but not limited to, cationic liposomes, cyclodextrins, porphyrin derivatives, branched chain dendrimers, polyethylenimine polymers, nanoparticles and microspheres (Dass C R. *J Pharm Pharmacol* 2002; 54(0:3-27).

The pharmaceutical formulations of the present disclosure, which can conveniently be presented in unit dosage form, can be prepared according to conventional techniques well known in the pharmaceutical industry. Such techniques include the step of bringing into association the active ingredients with the pharmaceutical carrier(s) or excipient(s). In general the formulations are prepared by uniformly and intimately bringing into association the active ingredients with liquid carriers or finely divided solid carriers or both, and then, if necessary, shaping the product.

For parenteral, subcutaneous, intradermal, or topical administration the formulation can include a sterile diluent, buffers, regulators of tonicity and antibacterials. The active ASOs can be prepared with carriers that protect against degradation or immediate elimination from the body, including implants or microcapsules with controlled release properties. For intravenous administration the carriers can be physiological saline or phosphate buffered saline. International Publication No. WO2007/031091 (A2), published Mar. 22, 2007, further provides suitable pharmaceutically acceptable diluent, carrier and adjuvants—which are hereby incorporated by reference.

IV. Diagnostics

This disclosure further provides a diagnostic method useful during diagnosis of cardiovascular diseases, e.g., a heart failure. Non-limiting examples of cardiovascular diseases that can be diagnosed with the present ASOs include, but are not limited to, coronary artery disease, stroke, heart failure, hypertensive heart disease, rheumatic heart disease, cardiomyopathy, heart arrhythmia, congenital heart disease, valvular heart disease carditis, aortic aneurysms, peripheral artery disease, thromboembolic disease, and venous thrombosis. In some embodiments, heart failure comprises a left-sided heart failure, a right-sided heart failure, a congestive heart failure, a heart failure with reduced ejection fraction (HFrEF), a heart failure with preserved ejection fraction (HFpEF), a heart failure with mid-range ejection fraction (HFmrEF), a hypertrophic cardiomyopathy (HCM), a hypertensive heart disease (HHD), or hypertensive hypertrophic cardiomyopathy.

The ASOs of the disclosure can be used to measure expression of CAMK2D transcript in a tissue or body fluid from an individual and comparing the measured expression level with a standard CAMK2D transcript expression level in normal tissue or body fluid, whereby an increase in the expression level compared to the standard is indicative of a disorder treatable by an ASO of the disclosure.

The ASOs of the disclosure can be used to assay CAMK2D transcript levels in a biological sample using any methods known to those of skill in the art. (Touboul et. al., *Anticancer Res.* (2002) 22 (6A): 3349-56; Verjout et. al., *Mutat. Res.* (2000) 640: 127-38); Stowe et. al., *J. Virol. Methods* (1998) 75 (1): 93-91).

The term "biological sample" refers to any biological sample obtained from an individual, cell line, tissue culture, or other source of cells potentially expressing CAMK2D transcript. Methods for obtaining such a biological sample from mammals are well known in the art.

V. Kits Comprising ASOs

This disclosure further provides kits that comprise an ASO of the disclosure described herein and that can be used to perform the methods described herein. In certain embodiments, a kit comprises at least one ASO in one or more containers. In some embodiments, the kits contain all of the components necessary and/or sufficient to perform a detection assay, including all controls, directions for performing assays, and any necessary software for analysis and presentation of results. One skilled in the art will readily recognize that the disclosed ASO can be readily incorporated into one of the established kit formats which are well known in the art.

VI. Methods of Using

The ASOs of the disclosure can be utilized as research reagents for, for example, diagnostics, therapeutics, and prophylaxis.

In research, such ASOs can be used to specifically inhibit the synthesis of CAMK2D protein (typically by degrading or inhibiting the mRNA and thereby prevent protein formation) in cells and experimental animals thereby facilitating functional analysis of the target or an appraisal of its usefulness as a target for therapeutic intervention. Further provided are methods of down-regulating the expression of CAMK2D mRNA and/or CAMK2D protein in cells or tissues comprising contacting the cells or tissues, in vitro or in vivo, with an effective amount of one or more of the ASOs, conjugates or compositions of the disclosure.

In diagnostics, the ASOs can be used to detect and quantitate CAMK2D transcript expression in cell and tissues by northern blotting, in-situ hybridization, or similar techniques.

For therapeutics, an animal or a human, suspected of having a disease or disorder, which can be treated by modulating the expression of CAMK2D transcript and/or CAMK2D protein is treated by administering ASOs in accordance with this disclosure. Further provided are methods of treating a mammal, such as treating a human, suspected of having or being prone to a disease or condition, associated with increased expression of CAMK2D transcript and/or CAMK2D protein by administering a therapeutically or prophylactically effective amount of one or more of the ASOs or compositions of the disclosure. The ASO, a conjugate, or a pharmaceutical composition according to the disclosure is typically administered in an effective amount. In some embodiments, the ASO or conjugate of the disclosure is used in therapy.

The disclosure further provides for an ASO according to the disclosure, for use for the treatment of one or more of the cardiovascular diseases referred to herein, such as a disease selected from a coronary artery disease, stroke, heart failure, hypertensive heart disease, rheumatic heart disease, cardiomyopathy, heart arrhythmia, congenital heart disease, valvular heart disease carditis, aortic aneurysms, peripheral artery disease, thromboembolic disease, and venous thrombosis.

In certain embodiments, the disease, disorder, or condition is associated with overexpression of CAMK2D gene transcript and/or CAMK2D protein.

The disclosure also provides for methods of inhibiting (e.g., by reducing) the expression of CAMK2D gene transcript and/or CAMK2D protein in a cell or a tissue, the method comprising contacting the cell or tissue, in vitro or in vivo, with an effective amount of one or more ASOs, conjugates, or pharmaceutical compositions thereof, of the disclosure to affect degradation of expression of CAMK2D gene transcript thereby reducing CAMK2D protein.

The disclosure also provides for the use of the ASO or conjugate of the disclosure as described for the manufacture of a medicament for the treatment of a disorder as referred to herein, or for a method of the treatment of as a disorder as referred to herein.

The disclosure further provides for a method for inhibiting or reducing CAMK2D protein in a cell which is expressing CAMK2D comprising administering an ASO or a conjugate according to the disclosure to the cell so as to affect the inhibition or reduction of CAMK2D protein in the cell.

The disclosure includes a method of reducing, ameliorating, preventing, or treating hyperexcitability of motor neurons (e.g., such as those found in cardiomyocytes) in a subject in need thereof comprising administering an ASO or a conjugate according to the disclosure.

The disclosure also provides for a method for treating a disorder as referred to herein the method comprising administering an ASO or a conjugate according to the disclosure as herein described and/or a pharmaceutical composition according to the disclosure to a patient in need thereof.

The ASOs and other compositions according to the disclosure can be used for the treatment of conditions associated with over expression of CAMK2D protein.

Generally stated, one aspect of the disclosure is directed to a method of treating a mammal suffering from or susceptible to conditions associated with abnormal levels of CAMK2D, comprising administering to the mammal and therapeutically effective amount of an ASO targeted to CAMK2D transcript that comprises one or more LNA units. The ASO, a conjugate, or a pharmaceutical composition according to the disclosure is typically administered in an effective amount.

An interesting aspect of the disclosure is directed to the use of an ASO (compound) as defined herein or a conjugate as defined herein for the preparation of a medicament for the treatment of a disease, disorder or condition as referred to herein.

The methods of the disclosure can be employed for treatment or prophylaxis against diseases caused by abnormal levels of CAMK2D protein. In some embodiments, diseases caused by abnormal levels of CAMK2D protein are cardiovascular diseases. In certain embodiments, cardiovascular diseases can include a coronary artery disease, stroke, heart failure, hypertensive heart disease, rheumatic heart disease, cardiomyopathy, heart arrhythmia, congenital heart disease, valvular heart disease carditis, aortic aneurysms, peripheral artery disease, thromboembolic disease, and venous thrombosis.

In certain embodiments, the cardiovascular disease is a heart failure, which can include a left-sided heart failure, a right-sided heart failure, congestive heart failure, a heart failure with reduced ejection fraction (HFrEF), a heart failure with preserved ejection fraction (HFpEF), a heart failure with mid-range ejection fraction (HFmrEF), a hypertrophic cardiomyopathy (HCM), a hypertensive heart disease (HHD), or hypertensive hypertrophic cardiomyopathy.

Alternatively stated, in some embodiments, the disclosure is furthermore directed to a method for treating abnormal levels of CAMK2D protein, the method comprising administering a ASO of the disclosure, or a conjugate of the disclosure or a pharmaceutical composition of the disclosure to a patient in need thereof.

The disclosure also relates to an ASO, a composition or a conjugate as defined herein for use as a medicament.

The disclosure further relates to use of a compound, composition, or a conjugate as defined herein for the manufacture of a medicament for the treatment of abnormal levels of CAMK2D protein or expression of mutant forms of CAMK2D protein (such as allelic variants, wherein the allelic variants are associated with one of the diseases referred to herein).

A patient who is in need of treatment is a patient suffering from or likely to suffer from the disease or disorder.

The practice of the present disclosure will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Sambrook et al., ed. (1989) Molecular Cloning A Laboratory Manual (2nd ed.; Cold Spring Harbor Laboratory Press); Sambrook et al., ed. (1992) Molecular Cloning: A Laboratory Manual, (Cold Springs Harbor Laboratory, NY); D. N. Glover ed., (1985) DNA Cloning, Volumes I and II; Gait, ed. (1984) Oligonucleotide Synthesis; Mullis et al. U.S. Pat. No. 4,683,195; Hames and Higgins, eds. (1984) Nucleic Acid Hybridization; Hames and Higgins, eds. (1984) Transcription And Translation; Freshney (1987) Culture Of Animal Cells (Alan R. Liss, Inc.); Immobilized Cells And Enzymes (IRL Press) (1986); Perbal (1984) A Practical Guide To Molecular Cloning; the treatise, Methods In Enzymology (Academic Press, Inc., N.Y.); Miller and Calos eds. (1987) Gene Transfer Vectors For Mammalian Cells, (Cold Spring Harbor Laboratory); Wu et al., eds., Methods In Enzymology, Vols. 154 and 155; Mayer and Walker, eds. (1987) Immunochemical Methods In Cell And Molecular Biology (Academic Press, London); Weir and Blackwell, eds., (1986) Handbook Of Experimental Immunology, Volumes I-IV; Manipulating the Mouse Embryo, Cold Spring Harbor Laboratory Press, Cold Spring Harbor, N.Y., (1986);); Crooke, Antisense drug Technology: Principles, Strategies and Applications, $2^{nd}$ Ed. CRC Press (2007) and in Ausubel et al. (1989) Current Protocols in Molecular Biology (John Wiley and Sons, Baltimore, Md.).

All of the references cited above, as well as all references cited herein, are incorporated herein by reference in their entireties.

The following examples are offered by way of illustration and not by way of limitation.

EXAMPLES

Example 1

Construction of ASOs

Antisense oligonucleotides described herein were designed to target various regions in the CAMK2D premRNA (SEQ ID NO: 1). For example, the ASOs were constructed to target the regions denoted using the start and end sites of SEQ ID NO: 1, as shown in FIGS. 1A and 1B. The exemplary sequences of the ASOs of the present disclosure are provided in FIGS. 1A and 1B. In some embodiments, the ASOs were designed to be gapmers as shown in FIG. 3. The disclosed gapmers were constructed to contain locked nucleic acids—LNAs (upper case letters). For example, a gapmer can have beta-deoxy LNA at the 5' end and the 3' end and have a phosphorothioate backbone. But the LNA can also be substituted with any other nucleoside analogs and the backbone can be other types of backbones (e.g., phosphodiester linkage, a phosphotriester linkage, a methylphosphonate linkage, a phosphoroamidate linkage, or any combinations thereof).

The ASOs were synthesized using methods well known in the art. Exemplary methods of preparing such ASOs are described in Barciszewski et al., Chapter 10—"Locked Nucleic Acid Aptamers" in *Nucleic Acid and Peptide Aptamers: Methods and Protocols*, vol. 535, Gunter Mayer (ed.) (2009), the entire contents of which is hereby expressly incorporated by reference herein.

Example 2 qPCR Assay to Measure Reduction of CAMK2D mRNA in HEK293 Cells

The ASOs of the present disclosure were tested for their ability to reduce CAMK2D mRNA expression in human embryonic kidney cells (HEK293) (European Collection of Authenticated Cell Cultures (ECACC), catalog no. 85120602). The HEK293 cells were grown in cell culture media (DMEM AQ D0819, 10% FBS, and Pen/Strep). Every 5 days, cells were trypsinized by washing with Phosphate Buffered Saline (PBS), followed by addition of 0.25% Trypsin-EDTA solution, 2-3 minutes incubation at 37° C., and trituration before cell seeding. Cells were maintained in culture for up to 15 passages.

For experimental use, 3,500 cells per well were seeded in 96 well plates in 100 µL growth media. ASOs were prepared from a 750 µM stock and dissolved in PBS. Approximately 24 hours after seeding the cells, ASOs were added to the cells at a final concentration of 25 µM. Cells were then incubated for 3 days without any media change. After incubation, cells were harvested by removal of media followed by addition of 125 µL PURELINK®Pro 96 Lysis buffer and 125 µL 70% ethanol. Then, RNA was purified according to the manufacture's instruction and eluted in a final volume of 50 µL water, resulting in an RNA concentration of 10-20 ng/µL. Next, RNA was diluted 10 fold in water prior to the one-step qPCR reaction.

For the one-step qPCR reaction, qPCR-mix (qScriptTMXLE 1-step RT-qPCR TOUGHMIX®Low ROX from QauntaBio) was mixed with two Taqman probes at a ratio 10:1:1 (qPCR mix: probe1:probe2) to generate the mastermix. Taqman probes were acquired from LifeTechnologies: CAMK2D Hs009943538_m1; GAPDH 4325792. The mastermix (6 µL) and RNA (4 µL, 1-2 ng/µL) were then mixed in a qPCR plate (MICROAMP® optical 384 well, catalog no. 4309849). After sealing the plate, the plate was given a quick spin, 1000 g for 1 minute at RT, and transferred to a Viia™ 7 system (Applied Biosystems, Thermo)., The following PCR conditions were used: 50° C. for 15 minutes; 95° C. for 3 minutes; 40 cycles of: 95° C. for 5 sec, followed by a temperature decrease of 1.6° C./sec, followed by 60° C. for 45 sec. The data was analyzed using the QUANTSTUDIO™ Real_time PCR Software. The percent inhibition for the ASO treated samples was calculated relative to the control treated samples. Results are shown in FIGS. 2 and 4.

Example 3

QUANTIGENE® Analysis (96-Well Assay) to Measure CAMK2D mRNA Reduction in Human Inducible Pluripotent Stem Cell-Derived Cardiomyocytes (hiPSC-CM)

The ability of ASOs to reduce human CAMK2D mRNA was measured in vitro by QUANTIGENE® analysis. Human inducible pluripotent stem cell-derived cardiomyocytes (hiPSC-CMs) from Cellular Dynamics International ("iCell²") cells were thawed, plated, and cultured per the manufacturer's instructions. These cardiomyocytes are derived from human induced pluripotent stem cells, which were first successfully differentiated into functional cardiomyocytes back in 2009. Zhang et al., *Circ Res* 104(4):230-41 (2009). Since then, hiPSC-CMs have been used to study various aspects of the human heart and related diseases. Because these cells bear the genetic traits of the human donors from whom they are obtained, they are often to be better predictors of human physiology or pathophysiology compared to existing animal models. Blazeski et al., *Prog Biophys Mol Biol* 110:166-177 (2012).

Workflow: Prior to cell seeding, pre-collagen-coated 96-well plates were coated with fibronectin as follows. Fibronectin (1 mg/mL) was diluted 1:100 in PBS ($-Ca^{2+}$, $-Mg^{2+}$) and 50 μL of dilute fibronectin solution was added to each well of the 96-well plate. The plate was gently shaken horizontally to ensure an even coating of fibronectin on the bottom of each well. Then the plates were incubated at 37° C. for 90 minutes. Cells were added to the plates immediately following aspiration of the fibronectin solution as per the manufacturer's instructions. Cells were seeded at 30,000 cells/well in 100 μL of the manufacturer's Plating Media and then incubated at 37° C. and 5% $CO_2$ for 4 hours. Then the Plating Media was aspirated and replaced with 100 μL of the manufacturer's Maintenance Media. Cells were incubated at 37° C. and 5% $CO_2$ with media exchange every other day. The ASOs were diluted in water and added to cells at DIV08 (i.e., 8 days post plating). The cells were then incubated at 37° C. and 5% $CO_2$ for 3 days following ASO addition to achieve steady state reduction of mRNA.

After the incubation, the media was removed and cells were lysed as follows. Working cell lysis buffer was made by adding 1 part proteinase K to 99 parts of QUANTIGENE® 3× lysis buffer and then diluting 1:3 in dH2O. The working lysis buffer was added to the plates at 220 uL/well. After adding lysis buffer, the plate was shaken on a plate shaker for 10 minutes are medium speed (i.e., speed 5-6 out of 10). The plates were then incubated at 55° C. for 30 minute. Following this incubation, the lysates were either frozen at –80° C. or assayed immediately. Measurement of lysate mRNA was performed using the QUANTIGENE® 2.0 Reagent System (AFFYMETRIX®), which quantifies RNA using a branched DNA signal amplification method reliant on the specifically-designed target RNA capture probe set.

Assay: Each well of the capture plate (96-well polystyrene plate coated with capture probes) was loaded with 20 uL of working probe set. Working probe set reagents were generated by combining nuclease-free water (12.05 lysis mixture (6.65 blocking reagent (1 and specific 2.0 probe set (0.3 μL) (human CAMK2D catalogue #SA-3000428 or human POLR2A catalogue #SA-10004) per manufacturer's instructions (QUANTIGENE® 2.0 AFFYMETRIX®). The cell lysates (or 1× lysis buffer for use in background control blank wells) were then added to the capture plates at a volume of 80 μL/well, giving 100 uL of total fluid per well. The plates were sealed using the QUANTIGENE® foil seal in combination with a hand crank sealer. Plates were centrifuged at 240 g for 60 seconds and then incubated for 16-20 hours at 55° C. to hybridize (target RNA capture).

Signal amplification and detection of target RNA began by washing plates with wash buffer 3 times (200, 300, and 300 μL/well in series, with buffer removal between each step) to remove any unbound material, followed by an upside-down centrifugation step for 1 min at 240 g to dry the wells. Next, the 2.0 Pre-Amplifier hybridization reagent (100 μL/well) was added, incubated at 55° C. for 1 hour, then aspirated, and wash buffer was added and aspirated 3 times (200, 300, and 300 uL/well in series, with buffer removal between each step), followed by an upside-down centrifugation step for 1 min at 240 g to dry the wells. The 2.0 Amplifier hybridization reagent was then added (100 μL/well), incubated for 1 hour at 55° C., and then the wash, aspiration, and drying steps were repeated as described above. The 2.0 Label Probe hybridization reagent was added next (100 μL/well), incubated for 1 hour at 50° C., and then the wash, aspiration, and drying steps were repeated as described previously. Then the 2.0 Substrate was added (100 μL/well) to the plates. Plates were incubated for 5 minutes at room temperature and then imaged on a PerkinElmer Envision multilabel plate reader in luminometer mode within 15 minutes.

Data determination: For the gene of interest, the average assay background signal was subtracted from the average signal of each technical replicate. The background-subtracted, average signals for the gene of interest were then normalized to the background-subtracted average signal for the housekeeping POLR2A mRNA. The percent inhibition for the treated sample was calculated relative to the control treated sample lysate. Results of QUANTIGENE® assays for cells treated with the ASOs at a concentration of 500 nM are provided in FIG. 4.

Example 4

Analysis of CAMK2D mRNA Reduction In Vivo

To evaluate the potency of the ASOs in reducing CAMK2D mRNA level in vivo, female
C57BL/6JBom mice were subcutaneously administered with one of the ASOs shown in FIG. 5. The ASOs were administered at a dose of 30 mg/kg/day for three consecutive days (day 1, 2, and 3). The mice were observed with regards to behavioral and body weight changes. Mice were sacrificed on day 8 and cardiac tissue was harvested for RNA isolation and analysis as described below.

MagNA Pure tissue lysis buffer (Roche) was added to the cardiac tissue section and homogenized using stainless steel beads until a uniform lysate was obtained. Incubation for 30 minutes at room temperature completed lysis. RNA was isolated using the MagNA Pure96 (Roche) with the Cellular RNA Large Volume Kit.

The RNA concentration was normalized to 5 ng/μl and one-step qPCR was performed using 20 ng RNA, qPCR Taqman Mastermix, and the following Taqman probes: CAMK2D (Thermo Mm00499266_m1) and GAPDH (Thermo 4352339E).

PCR conditions were as follows: 50° C. for 15 minutes; 95° C. for 3 minutes; 40 cycles of: 95° C. for 5 sec. The data was analyzed using the QUANTSTUDIO™ Real-time PCR Software. The percent inhibition for the ASO treated samples was calculated relative to saline treated samples.

As shown in FIG. 5, all the ASOs tested were able to decrease CAMK2D mRNA level when administered to the C57BL/6JBom mice. Collectively, the results provided herein demonstrate the potency of the ASOs both in vitro and in vivo, and support that CAMK2D-specific ASOs are disease-modifying therapeutics for the treatment of various medical disorders, such as cardiovascular-related diseases or disorders.

SEQUENCE LISTING (1713 sequences)

SEQ ID NO: 1 - DNA, 310896 bp, Homo Sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagtaagcacctttgcccggcatccgcatatcccctttccagctgagggcgggtcgcgttgcccccgacccaccggcctccgtcttggggcgagggagtttgggagaggaatgggaggagggcccctggtttgtcagctctggggaaggtgctgtcttaataaagggagggagcacagaaggggtaggacccttactccaactgtggctcattttgatggtccctagcccaccttctcccggtcccccaccctcctgcactgagagacttagtgaatttacgatctctgcagttgtagctatcatcctgagaagtgtgcgcgcgcgcctgtgtgtaatgtgtgtttggagaggaaattagaacccatgtaaaatgcaacatagatcatgttttctgtaaatagagatgcctcctggttagccggcgtgtcggccgtatgacccaggtactgatgagaactcacagcctcagacggtgccatatttattgatgccgaaagttcaacttggcatagagtctatttcgcatccagtagttgttctgtccaggaaaagggccacccaacagaacccaaccccttgccctatatccagtgttgttctttgcaccagattaccgctcaccatcattcttcctaggatttacgtgtgcatctttgcgttctctgggaggatttatttatacaggcaacggaaaagccctctggagactgagagcgctcttaagcgtagcctagcattgtgtaaaaccacctccttcacccgactggcagaactacttggagatgttagggaaggaggcaggagacctactgaggacttatgcaaagggacctaggggccaagccgtgaatgctgatttttgtagcatggaacccaaacccaattcctctttcactagtttcgactgttacttttatgaaaggagtgcgtttatatgtatgttgttggtttatactgtaattaaaggaaaggtaaatatttttaaaagtaataaaaattacatatgtatatattgtctggtgttaaaacatggagaatatgtcggaagagcagcttaattcaaatctctcccctcccccagtccaaaacaaggcatagagaaatcaccataccaggatttgttaaaccacactaatgtgctcaagatttatattttaatgaaaataatcgtcatgtttacttacttggaaccacattaattttttgtttcctaccaaaataagtaggcagcagatttttttgctgctcctcgtctgctctgttctgtgcagggtttttctcagagcatttggtgctgtgagtgtgaactgtaaaatgttttcaaatttcttgtgcaaacaagagcggtcataattggcagttcctttcattttgttgattaataatgtgtgctcccagttaaataaaatttacttttattcttcaacattaaagaaagtctgggtttccaggaagaattgttcatttactggatattactgtacttcactggcaatccactaaaatcaataaaaatgctcagattttataaatttttaatgaaatattatatctgttatattaatgacctgctaattattggtttccaggggggcattctcagtggtgagaagatgtatgaaaattcctactggacaagaatatgctgccaaaattatcaacaccaaaaagctttctgctaggggtgggtattttcaaccacatatattggttaattttgtatttgtcatgttgattataggttctgttgtatgtaaatatatcatgtagttataactgaactttagacttaggtatcatattatatattaagattattttcttcctgaatgcttcttggtctgtacagcttaaaaatacatggaaagatataattattatttgatacattgctattaaaattctatctgtcctatgagcaatagcatgaataactatattttaaagcaaataaatgtcaggtgcattttgcttatagtttaagtataaaacaacttttagaccatggaatggaaaaatataagtctcacaactgtcataattcccttttgcttttgagagggaagtaggtcatagctcagttgaatcatacatttcaattgtagttacacttgaacttaattcatcaaggtatatttaacagtaatagctttggtaagaaaatttatgattgctatattctaggaagtttagttttattttgatgtttctgtgtgcagctcagaccttggtcttcgcattaaggcttcacacagactcatgtaatgtattttacacatgtagtttataggtacagagataattcatactcgtaaaatagctgttgacataaccaaaaaacttggagggctctcactgcattctttttatttagtagaactcatgcaaaagtacttacgctgaaatgttaggcattccaattattgtgggcacgtgtctgaggtatttccatgggaatttatggtataaaaatgaaatgaaaatgaacaaaataccatagtgtacgctcatctcagtgacctggtttattttaagtaatgagagaagaaattccattaggtttagttttcctcatttaatatgtcttttcaaaagtgcttcttaccaaaatcctggcatcattgctttcggtctctgccatgattagtttttccatatttattgcaaattctacttttaacatgcattttaggtttaggttggtattttagtttatccattcacatgggttgttgttttaatttccttcatctgattttgacatgattctgagaaagatctataaagtaaccagcaccatagaatcatggtatgaaaactaatgagaagaatattatgttaattatgttctcttagtctctactccacagaaaggttttaacaatgaaaaggaattgctaaactataagtgacattttaatttaaaaaaatgaaaatgtgtagttagaatctttcagtgcttctcttattttcttctgtgtgctagatacttttggctgtggtgggggtatcatttcttttgaaagcattacaatacctattccaagatttttggtggtgtttctttcaaaacaaatcagtgtagtgcttcacttttactaactttcttaattagagccatccctcttcactcatctgaatttgtcctccctaaatcagaataacaaatgtacttatccctggtcacatacattttactctcttttcccttcaatctgtggagaagaagccttctttggcctgatggaatcttttctccttgctactccaccagtgtttccttacttgctcatattctgcttcaaagaactacctacatgtcccaaagctttttaccgcttctggatgtaatgattttcattattctacttagaaaaaggaactagggtgaagagttaggagacattcttcttgcccgttttctgcaattttttttccttgtgactttgggcaagtttcttaacctgttgtaggttaacgtacctaagagtgagctggtggtgaagaacattattaacgctgcaaccagaagctcttgagtttaacttctgctgcccatacctactggctgtgtgatcttgagcacattaactagtttctctgagcctcagtttcttcatctgtaaaatagcagtaataacagaacccttcctcatagggttttgtgtggaatgaatgaattaacatagcatagaacagcacctgccccactatatgcagtcaatgaatattatctgctattattatctaataaaattgtcataatgatcaaattagattacttttatgaaagaacttataaatccagtggcagccttgatttagctgtgagaactacgtttgaatctttgctctactacttaggcataaatttcgtttagtctctttccttttctggatatcaggttcttcatcagtaaaatgggaaatcatactcatggagtctcatggggtgttctgaggattcagggaattcaatgagaatcatttcttaaactgcaaagtattgtgtcaattttacctcttattattgttctcctgaaaaattacagaacttttccttcaaaatggtcaacaattttattttatattgtcacactaatcagaactggttgtagaatatttgtgcctttgaatgaatacgtttgtttaacttgtactcatattgaattataaactcttgaagaagaaaataccatgctttcattttttgatacaacattccacagaattgagagcatagaaggggctcagtacagagtaacaagaatcaaatgtggttgttaaatgacttgtaagagttaagtacttaatttactcctaacaacaagcaaatactgaaaataaatccgtgaagtagtatattaagaggatatgtcttaacctatgaagtcttttaataacactcatttcagagaagatgatacaaatcatttttgcagaaaaatttttaaaataatgaatacgttcaaaggcaaatgtagaaagaattgcaaaatagtatgcttgttttttctaaggtactgatttttgagagttgcatatggaagcttttgtggagcatactttttttgtgcaaatttttgtttgtatttgaaattccatgactctgtatacccaagcctttagtctatttgttttaaagaccaggcaggtcctccaactccactaatgttctttaaatgtaacattacagctgaaaaagaaagggctattgttaataaatctaagaccatgagggaattgccaaagatttggctacattcctgcataaatttgcacatccaactatactatcaaccaggcatttttctgtgcctagattttaatggatttccagcagacagtttcagttgtatttcctctcagctgttagtcatacataccatatttggggaactctgagtcaattgaagaatttcttaccttttgtgttagcatgtgcgtgcatagaacattcattatactgagcatgtagatgggtacactcatatataatttggcttattttgaaaataagtagtatggaagcatctcaagcatcttatattttatatgtaatttctatcttctaaaaagtttttgttagatgggcattgagggcatgcttagtaaatgttgaatagtgataatagaatttttgccttatattttcatgagaattagaaattacgccattttaatcccaagcacagttagattagtacttaacaaaagccaatttttttctgctgctttgatattctgtttatttatacatgtttagaactgtacactgttgtcaaattatataaagtccaagaagagctgtgactgcagttcagaatccagtggactgatggttctgatggcagataatttagaaatagtacctgtgatttattttgcatttcaaagcctcgtggtggtaaaatattttatgtggaagtaatggcttcttgacattcatctcccagtgtatttcttgatcgttagaaaccatttgactattacatagattctgatgtgtcacagtcactgtttttgtaaaatataatacattatagtatagggttaaaaaataagttattacaactgtattttacctctactccattgctaaagttaaaagggatttcattttatatttctgtaaaacttcaggcttaatcagttaagtcattttgatattctttgattttactagttttattaattcctaaattggtgatattagtagtacatgaatcaggactttataaaactacttgaccatgtatgcaaaattaggcctcatctataaaatctaaatgttttgtgtgtgtgtgtgtgtgtgtgtgtgtgtgtgtgtatccctaagtaaccttttttgatgttgtaaaagggatgttaaaaactaattcttgctacttttcttttatttttggcttccaggcagtcaagaaagtactgtaatttctcaacttcatggttacttgtcttgaattggaagtagaactgagactatgtagatggattaagttctgattatacattattgatttggcaaattggaacaatttggacaaattaaaatttgaaggtttcttggcaagaacaacattttaagaaaaaaattagtaaatcatttttatatttgtacatagaatctccacaactcttcagttatggacccagaagtggcatgtgtcatccttattattttgtatcctttacttacgtttagttgtatttacattcttctataggtcttgatattaaacattcattttcttctttcattgaatgaaagcattactgctcttcagaactagttaggagacacaaataataaaaaaaaaaagtatatccacacttccaggaaataatagaattcttttctgtatttcattaaatgaagaaaataaagaaagtggttgtcaggtgccatactgtgatattaataactagtgtaaacctctacctgattgtgtgagaactttgtttagacaattagattaatacttctcatttccattgaaatgttgaataaactgaatataaaaattaaaatttagcaatatgtcaccttttatggatctttttaatggtaataatcacgaattactagaaatcttacatgtactgggcttttcttgggcatctaacttttttgttaactagaattttaatttatttttaaagtcttccttgggcttatactgaggttgactcatagtatttctagggctggattggtatattttttaacatcagtcttccccatttattagggtgtaatgtatgcagtgttttaataaatcattggcaattaatgattatatagaggctgtgttaaagattttaagttacaatagtatttctagtaaactacactgcaatgcattaaatggagtattagcaatattttaactgtaaaacatatctttatatttcaaatcactttatagatcattaagcatattcacatgtctttatgtgtttatttaataaatattaaatgatttcagtggacagtgttaggaaaaataaaggctatctacctaaataaacataatagaagacatgaatggcattacaattcaagcatgaataaagtactatgggctcttaaaggaggacaagattatttctgcccagggagataaagaaagcctttcatatagtattgatttaaagaaattttgaaagctataatgtagatggggcttaagtaccacccccgcccccacccaaccgaaaaaaaaagtctaaataaatgatttggggaagttgctcaaagtagtttaaatatctgattataacaaaatgttatgttattcatatggtaaatttgttgtaattatcagtatacagttatttttagaataaaattattttaaatgacgtaggctgtttcttaagtgacaaaattcctctaattccagttgagagatttagcaatacttaaggagaaatcatagaccttttatctgccataacttctcttactctagcatagggaaattggtaggtttgaagaggagagagggcagcttttttgttaagtttgtttggttttgtttttaaatctcttagctatcattgtaattacacacaatgacacaatgacatcactgatttttttagttacctgagccccttttctggtgttacagtctcattttaactccttagaactatgtttattactaccaaaatcaataatgccatcttcatcattaataataatttagaaaaatataaatattaatagccattatttgaagagccccttctatgagacaataagtatatatttacaagatactttgttttattttatttaatccacactgcagcctcctagaacaatattatgtccattttaaaaaagaatactgaggctcttgtataaggcctcaaaattagtaagtgataagagtcaggatttcaatctggttttctctgactgtaaattctgactctttccactgtcacctcctgttgattgctattagagaggacttatcttaatctgtctgtatttacctgtgtgtgcttaactgatcttacaaacttcagagtccttcatacaaagcactatgccttacattttatcttcccattgcagtgtgggggattgagtatttctttgggaaaatacatttagagttccaacctgtgagagaagatagtcttttaaatgctactataacaagatcaaagtgaagtttcagacagtccctccatgctgtcttctggaaggacaacaatatagtgaaaaatgttattataaaatggtaggaaaatggttaaagaggagttcagtattttggtaaacttaattcattaactgattaaaaatatctcactatacagtaagtttctaggattacttcttctaaatgattcagttgtcactgcaaactaaaactcagcccttaaccgaagcccagagaaacctactcagaaagctgttctactcttctggttcatcttgtttaaccagtgaacaatggaagacaaatttttgttgttttgtagtttccttttgaacaacattgttgtatgtagcaaattcttacaaaaatgtggcaatttaaagaaaaatataaaattgtcaagttctatatttgttgaaaaaataacttaggtgcagcaagtagtataaaggtacacaaagtattgtgatataatatttatatacagttaattgttttacaataggtttcctgttttccttcagttacattgattacataggaatgttaaaagttttattgcataaaatttgatatatataattatatcatatatatttaattttataacaataagcacccaataagcctccactcaataactagaacattctccctacttttgaagctacctgtgtgctttttgttgatccctatcctttgtatctccccgagagctaatcaccatccctaacttttttaggagagaaacctctttttatttcttcataccctggggttttttaattaactggctgatctcagtgggccagtcattcatggaataaatatatgtagccattttctaggtaaattgtattttattttattttgtgtggtatatgtgtaaactcatggaataaaatacattacttctcatatattagtatataattttaccctcttaaatataggcaatgcttaatttatttggaatttgtttagtaacaggaaattattttcttcctatgtctgataaaattttttttaaaattatttatttatttattttgagacagagtctcgctctgtcgcccaagctggagtgcagtggtgctatctcggctcactgcaacctcggcctcccaggttcaagtgattctcctgcctcagcctcctgagtagctgggattacaggtgcgtgccaccacgcctggctaatttttgcatttttagtagaggcaggatttcaccatgttggtcaggctggtctcgaacaccggacctcgtgatccacccacttaggccttccaaagtgctgggattacaggtgttagccgccgcacctggccaaaattttattaatgataatgtatacacattgaaataaagcatgaataacttatataaaagtaacttattaaatgtaaatatagtaagtgaaaatttatcaaaattttctgttttataaagaaattgtggatagttgatatatgccacattatgctattagtgtttaaattaaaatttgatgttttgttgaggaaataagtacttttgcatttttttgaggcaatgttctggataatttgaatttctgctgagggttatttgttagtaatacagccccaaactcagcatattcccagtagactcatcaactttccccctctgtgaatggcacaataattttcctaagctttcaagcatgcctgatttttttctttttcttatcccatctcaacacctttttcatttcttccttttcaccatcccaatttgaactctcttttctttttgcttcaactctttgttttgtgttttgagacacagtttctctgttacccaggctctagtgcatttgtgagaacctagcttactgcagcctccaatgcctgggctcaagtgatcctcctgcctcagcctcctgagtagctggaactacagtcatgtggcaccatgcccaagtagttgtttgttttattttttttaaagacagagtctctctgtgttcctcaggctggttggtcttgaacttctgggtgtaaggcaatccccctatctcaggctctgaaagtcctgggattacaggcgtgagctactcactgtgcctggctgcttcaactcttttagatagcctcctaaatgggtttggtagataatagttgcacattttttattcgtttattcagctcatcattagatcttttagcactcgctttgctgggcaacttgataagttttagagatccagaggtaaaagacagacattccttcctcaagtatttcctggcctatgagtgtggatgacagcctggcatttagtagagttagtgaaagggctgtgatagacgcgtgcacagggcttttgagagcatgcagaaacaggcttggggaggttggtctcacagatttcctgaaaagattgatgtgtgaggttgtattttgaataaattaggtgagcctgctagagaagggagtaagcaatctgttcacagggagggagaaagttcctgctccatcttcctgatggagtgagtacacctggtactgttgcagtactctctcctttaagatccagtgcaggtcctgcctcctccatggtctctaacttcttcccccacctctccttactttctctagccagagagattgttgtctccttctttgtcctttcaatagatatttcatatcttatggagcttgccagatttctccctttgtattgcagtcatacatgttgtggccttcaggcatttggtgacatttcttagtttatctttcagtctgcgcctggcacagtaattaatattgcagatacttgtaaatgtttgttggataagtggacaaataattgcatgaccaaataagattctgtatcttgaaatagacatgcttcaaagagaaacttatgactggcaaagtaaattgaaaattgactaagacttcatgtcaaatagcatacaataactctataaattaatttgtaattcacaaattatttcataagttttgtcatgacaaattctgctttattggaaagagttttgtataattcagtattttctttttgagcaactacttgcaaattcttattgctgctctttttttaaaccatgtattataaagtggctcattaatgagggctaacattttcatggtctgtgtgtccatcagcaccactttaataattccagactcatgtcatgattaaattattttaacatgtttgagtttaaaaaaattttgatccattctacagaggtatctgattactttttcatttattttttgacaaagcttatttttaagcagtatggtgacactttatagagttttagatatacatatcatggatgttattagcttagaggatatttgattttttttagtaaaggcagttagaggccagctgtttcaactgctgtgtctgtcagttgagaaatttggtgagggagagtgtacttgtttctgtattggaaggctctttaaacagaatgcatgttgaaaagcacttacttgtgttctctcctcaaggaaatttcttgtgtgatatgttgcaagacactgggtggggggggcggggttccaaattctatagctttacagtgctaatacatatactaaattagagacatatttctaatacctattctaatatatttaatattatatattacattctatttatagctattatatatgagaaaatattcttttcataaaagtattcctatcatatttttaaatgatgacttaaagcctttaatcatagtggcaatagtgatttggggagttagttcaggtgtacattttggcagttttgtagaaattgtatccatgatgaatattttattactttgataaagtgaattttatatgctttaatactaaacattaatatttgttaggtatagaattacaaacttcagacatacctctgaaataaatctttattacagttttgtataaatacattttaaaataatcatatcataaaatatatatattctaattacagaatttggggaaatatggaaaaatagaatgagggaaagacatatttgtagttcatttcccccaaacaagcactgttaacattttgtcactttctttttcttcagaatactggactaaaatattacaattttatgtcctgcttttttacttaaaattataaaacttccctatgtactgcaaatcttttgaattcttaataagtgaattatacttcactaagtgactagaaaactgattaattattttggtattcctagtattttttttaatttttgctttttgctatgatgactggcactattatagacattcttttgtataactttttttatagttctgattagtttcttaggaaatattcatagaggagaattaatgggttagaggattaaatatcatcaaaattattcttgcctaattacttcctgtaaattttgtgtgtttccaccaatgacaaagtatgcgagcgagaaattgaattttaaggagcgtgattctaaattttaacttcaatttaacaaaaaatgcttattcaccatgttctggtccttctgctaggtgctggataaatgaaggtacaaaggacaaaagtccctcctttcaaggtgaacagatgtaaagtcaagtaaaattaccattcaggttgataaatctaacaatgggagtgtttactgggttctgaggtgtaggagataactgttgggttgatgagaggtcagggaaaacttcctagaggagctgatgtttgaactggatttccaaaagaatcagtttttgaactgagagataggtaggaaaaaaaacaagttcaaagtatatgttgaaaaaatactcacgagaagccagaatattggaacgtaccaataaagactgaacttgagaaaagcactttctaactcttggtgatagacttatcaggtatagagtttcatgaaacatgcaaaaacgggtgaaaagaatgggagttttttcttccaacgaatcattaagtatggcaagagctgttggaggttcttaaataaggcagattgtagaattttacaacactgagttacttgaaatgaacaggtgataagagaggaataattaacctcttacctacctcatattttgttttagtgagccttggggcaatacaaaaaattaagagtgactaagtagaaaataaaggacgggaggataattagaatttgtttttaaaaatcggctagtactttaaaaggtagttcctatagttgcaatatggattaatgactgtttaaaaaagttcataagtttctgctcaaatccaaaactaagatatctaaaaatggtactgacattattaactgcttgaatgcctattgtcaagagtagtgtttggcacccaccacaggtatttattgaaaacataaaggaataaaatgattcccaaatgatatcatcttatgattaatgaatacacatttgaggacctagaacttttagcagtaagatttgcatacgcttttcctattgaatttaaaaaaaaaaaaaagttcaaaattctgttagattaattctgtgatatagtttataatttggcataagctggtagtagggaaatagtcacttctttatgcccatgatttatataatgaaacaatcttccattcacttagaagacaacttcgatttaaatatttagcctccctagcaaggcccagccatgcaattttttccctgttagaagaattttagcaacagtaaaaaaaattaatatgtaagattttgctatttttattagttttgaggactgcttgccttgtagtttaaagggggtaaaaaggatcattgttttactcaatgtatatatatatatatattattaatggtagattttttttttttttggttgatgtaggaactttgggagtagagcagaaagcctattgacttcaaaaatagtgactcagggttggtataatcattagtaagcaggttgggaaaaatcctaattccagacctcaagtagaattttagtatcagagtcactcctgttccttaaatgtagatctcctgatttcaggccatttttcattctaatagaattagagaagaaaaataaaacctgtcaacgaggactatttacctcctatagataggattgagacctacttttctgtaacttttgaagttatttttgggaaaaatttccttgggttgactttgcccccttcacccaatgcatctgtgtgatcaggaaaagggaaaacaagatttaattgttaacttttaaaaagtccttttgaaagaaaaaaatatatactgtcttatattgacagagaaccaattattgggttacctgcaacactgtatcctccatttagtgctgataatcataatgtccataatctcccaataagataaaataataaagaggctctgaggcatgaacaggggtggctaaaggatcattgagataacttttaaaataataatgatttatagaaattgagttaatatttgttgaccttctacaaactttaaaacagatagaaggttttaaggtatatgttttgaaataatccaaaccaaataaatctaaacttagaaataccatattagaaatatacagtgaacacacacaaggtcaattttaaaaacagcacttagctttgagcagataatttctccttcaccctgaatgcaaataatttattcagcccttctataacaagcttaggggataaaagaggcaaagggcatgagaaatgagtctttggaaaattattgtaactaacactaatgcttatttagcatctttcattcaaagaccttcagacatttcctaattgagttctgtagtacttctggagtgtgggtaaggaacatttagagactcctgtgcccagtgctgtaaggcctgccatccccgtgtggcatgttgcagctgttttgtagggtacatcatattccttcctgggccagagaatggaggagacagcgttatccagctgaaatcccagaaggattaggggaacaggagtgaattacctggattggaatttggccagctttctgggtcagaaatcctattcctataaaaatgttctatctttaaaacattttatatcctgctttatctccaagaaaataaacgctacatcacttattttctgcaaatacctttgggagcttaacattaatattgaggaatgtgacagcctatatctactattaatgaggaaagaaagcgaggttaacattttatctaaaagatattagaagagaaaaactatttgtattatgcctgtcgaaagtaagctgtgggggacatgaagataataacatatgaccagttcccacaaaaaacttacaaactggtttgatgaataggagacatacatagataattatggggaagatatatatgtatcttcagtatcagaagaaagtattatgagaattcagtgtagcctagtgatgacatttaatggcagaagcaagaaaggtaacattgaggaagcagaagtggcagtgcatagaaggaagaaagaaggacaaagacacaggaatgcaggaaagtatcaatgtttagggaagaaccaaaaatgtttatttgggcaaaggatagacaatctgggaaatcaggaaagaaaaggttaaaaacacgtaaaggtagtttaccaaattgcaaatttgctcttaagtataccagagacacattaaagagagcctctatgatgttacttggtagcagtgaatgaatacgatggattggcctggattatgagagacactgagattctgaaaccttaagataataacagatgtggcaggagggctgaagtttcaaagctgagtcatggggagaattagttttcgtgtaactagttgagaagtgagaatcaagaactgattttgatgagggaagatgattaattgatatgtatttgaggtatacacaatatattcacactgacttatcaaaaagacctttgaaaattgggtgtggtccttgaaaagtgcctctggagaacatgcaatgtactgtgtaggttaccagcattggctgtgaaatcagattgccaagattcaagaagtggctctgccacttccaagttcttgtgaccttctcaagccttggttttcttatctataaaactgtgataatcaattttgcggctatgataatcaattttgtgattcatttgcacggagaagatagtagaagctatgctagtggataagataacaatggagagtatagaaaggaaagaaaagagggcctaggatagtggtgtagggaaatactgcattttaatggatgaaaagagggctagtttaggataaatggaaggatatggcagaaaggtatgaaggaaattaggataatgcagtgatttgaattctgagggagggaatttttgcaaaggaggggtggctagtaatgttcagaattgtagagaagtagagagaaatgaagaccaagaaaaggccttgatttcccatatggcagaatttcaatagtgtttaggacaaggtcacgaggattgggtcattagactgttacttgttttcgtatgctcagaacctagcacattgcataaaataaaataggtatttaatgtttgctgaaggataaagaattaatgactttcttgggattaaggaacaaatggcgataacatgaaaaagcttgcttgtttaacaaaatagggggctgggtgtggtggctcacgcctgtaatcccagcactttgggaggcctaggtgggcggatcgcgaggtcaggagatccagaccatctggctaacactgtgaaaaccccttctctactaaaaatacaaaaatttagccgggtgtggtggcgggcccctgtagtcccagctactcaggagcctaaggcaggagaatggcatgaacctggaaggcagagcttgcagtaagccaggattgcaccactgcactccagcctgggcgacacagtgagactcttatctcaaaaaaaaaaagtagggaagataaaagagaaaaagagaattgggagtaatttcagggattcctcaggtcaagggaattaactttggggataaataaaaccaaagcttatttgaaagaagaggaaaaagactaaggaagagaaggactgataatgcaaagaaagagggtagtatttattgggcacagatgaggaggttgtgggcatgagtgagaataagagataagcttggggaaaatgaattctttttcctcagcgggcaccaagagtgagaaaacagcacataccgaaaggttttgaggtggagaagagggcagttatagttctgctgagaagaagagaaatagaagtggggttgagaagttggatggtctttggagactgtagaaaggagacaaccaaaagcattgtgcagtagtagtaacaacctgaatcattagcaggtacaggccttgaatctagcaccaaagtgtccaaaaatggctcccagaacctgtggctcagcaaagtgagactgcagagaatctggcatttttaaaagatttaaggagaagaggtatcttttgtttacattaatttttcttaattcacatggctagtaataatagagcaactagaatttaaacccaaactagctaatagcaaaatccttgatattgtcattctgttatgttccttccaagttgcatctagcagagagatgaggtgagggaggcagttagaaaacaaaaaattgaaaagaaaattttattctctaggaataacggccagaatgatgtcattttggaatgttcagtaacatatttctttttctacttgaaagtgaaacctgggaaatctgtaatttacaatctaagtttcccttattacgattcaatttcattccatttttctgcataaactaaggactctacaggcagcttttgatggctcagggttgtacatagtttttatcagtaggaaagtactatttatagataaaaattatcatagatcagaaataggtagtacatgctatgaaaacataaattggttcatcctggatgtcatattaccaaagttgaatatggctcatcatcatgaatattctatttcttgtgccttgcttacattcctatctatatgtctctggtttagtgactgtgacgattggggcttttggtttggtaagttttcccaaaagcattggtattcctaataccttttttaaaaagtctgtctctttttaaaatttgcttttctaagtttactacaaaggtttactttgctccttgaggaaaaaaaaaaaatgaactcaagaattgttattgaggtaggtgtgattagaatgtgtttgatgttgttttttctttttacataccatgttttttccactttattattcttttgcccatttcttctcccattgctattattattgatgtttaaaatctaattattcatgatttttcccttctctaccaccctatttttcacaaagaaaacagtttcttgagttcagacttcaaagttctggaagacatcttctttgtaccttccccagttattagcttttatctaataaggaaaagtttgatattttttatgctgaaacttttgtaactcttggactttgtttctctggttcccaaggtctctcatgtcttatattgccctcattatatcagtcatcattatttgttcattcatttactcatctatttaacaaatatttattgagcaactgctgtgtgtaggcacagttcttgattcagggggtaggttggtgaagagagttaagatgagagacatgggaaaaggcatttggatagataagtaccatgcagtgctatgaagaaaatatagcagggctataaattagataatgacctcattggagttactttagatagagctgaggaagaagcatttgagctgaggcattaacgatgaaaagaagcaaaccgtgagaaaatacgaagaaagaacattccaggccaaaggaccaaggtgacagtgagcttgcacaggagtagaaagaaagtcaatgtggctggagtgtaattagcaaggagagaagtacatgatgatgttgggaggtaggcaggggatggattgtgtagagtcttttagccaagttaaggaatttggatcttattttaaatgcattgataagccgtttaaggatgtgaagcagggaagtaatgtgataggattttgttttaaaaaatatctctctggctgccatgtggagaatacattgtaaggaagtgtgagtgaaagcaagactatagtagtctccccttgtctctgggggatacgttccaagacccccagttggtgtctgaaactacagattgcacaaaactatatatactgtatttttcctatacatacataaatatgataaagtttaatttataaattagtcacagtaagagatgagcaagtactaataaaatagaacaattataataatatactataataaaagttattctgtgcatgtaacttttgcagtttgaagtgcgacagcaaaactgcatgaatttctttctccttcttcacaatttcatggatagaagatttattcttaccatagatcttagcatatacattttttatttccttattaaggggagaactttcacctttgcacttaaaggaagcacagtttcctttgctgaacggcttctccttggcatattccaattgccagtatcactactcttgcactttggggccattactaagtaaaataatggttgcttgaatacagcactgtggtactgcagcagtctgtgataactaagatggctgacaggcaggtagcataaacaatgtggatccactggacaaagggatgattcacatcctgggctggacagagttaggtgttacaagattttatcatgcttctcagaatggcacccaatttaaaatttattaattgtttatttcagaatttttccacttaacagttttggatggtggttgactgcaggtagctgaaacctcagaaagcaaaactgaattaagaggagactactatagttaggagactcttgcagtctaggggagatgtgaaggtgacattagaaatagtgagaaggatggattttggaggaggaaatttaggacttgctgatggaaaggttgtgaggtgtgagggaaagtgaggaagcatgactattgatctacattagatctagtagtcatctcatagtagatgactactagtcaaaccaactatctaatggtggcactgtaactgagaaggggaaaagtagagtatactaagattggaatgggaaatcaagagtccaggtcttgacttaaatgtgagatttattacaccttacctattagcaatgattcatcattcttacctctcctcctctccctcaaacccaggcaaccactcatctattttctgtctctataggttttattctgaacatttcatgtcagtggaatcatacaatttttttttctgattggcttctttcatttagcataatactttcaaggtgcatccatagtatagcatgttttattgttaaataatatttcattatatgggtataccacattttgtttatcagttcatcagctgaaggacttttggattgtttctaccttttgtccattctgagtaatgctgctatgaacatttatatccaagttttttgtgtagacgtaagtttttatttttcttgggtatatacctaggaatggaggaaatgctgtacatacacacattcaagaaatacaaaggaaacattttatgagatagtactctatagtataggattcaattattactaaacagattaatttgcattataacacatgtgcatataattaatagccaagacacttggaatagtttagatattttgaagtgtgaaaaagaaatggagtgaagaggatggaaggggtcaagggctaaaaaactgcttattgggtactatgcttagtacctgggtgatgggttcaattataccccaaacctcagcatcacacagtatatctttgtaacaaacttgaacatgtaccccctgaatctaaaataaaagttgaaaaaaacaggacatggaagttgagtttcagaataagaaagtaaattatgaccattttcactttgtaaatgagaagtattatatcatgtaggaaagtttttatttaaccatgattttaaattagctatgcctggagttgaaagaaacatctatttcatgtcaaagaaacatcaacctattattgaatgatctctttactcatgtcaattattactagaaagaatttggcttgggagctttatttgtatcatagactttttttagactattgatgtagatggctatttttcttttaattgagtggaaagttttataagtcttatattggatccaccccttcctgttccttttttgttggcaagtgcctgtttttgcatattacttgctgggctgtggcagatacccacagcctatgacactggcataaaatttgctaggcttttgcttttggggtaggaagctgtgctggggattgatagtgggcagaggactgaggagaagtagattgaaattctctttcactaaaacctggggttagtttgatggtcagtgagaagtttccattttaatcttttaaattgaagagtacatttaggattcattgaaagcctaataatgcaacaccctgcctttctttccagtgaaattttgaatgttgaatttcagttcttttgcagcattgtattttcttgatctgcctgacaaaacaagattaacacatctatgaagtatttccatttacactgtggttctaagtgctatgaacagtaaggaatggaaaagaacaaagaaagttgcattttttgaaggaatctttgaattcacagttaatatttatttttacaaatcaaaaacccatttttgggatgtgttatttatttttgtatatatttaaaatttgatgtatatttccaagtgagttagtaaatattgttccccatattacatcattcataaaatgcttcgattaatttttaaaactaggctggattaatagccttttaaagcctttcagttgactcttcccccaaaattttcagtgacatgggaaagttcatattgggaaaatttcccttgatatttgaatggtgaatatatactaatattatttcattatatttttagtgatatatttagtatatggagatatatacatatatagacaggattcttaagaaggagatacaggaaccataaaaagttatgttttgccagaattatgttttgccagagtccactaaagaggataataacacattaaaaatatttttttgcattcactcattgtgcaatatcctattttcatttaaaaaaaatcaggttggtaagtctactggaaacatgagactgcttaactttcccacacattctttctcccttgtgggttttcatatgggtatatttaaacagctgcatgaaaccattatttgtggaggatggattggaagggaacatttacagaccatcttgtataatatttaggtcttctttaggcagaaccatcagagaactaagtatagtgattttatagataggagtttattatttcatctaacttagttttttctcacagtagtttttttttttttttcaaagaacatatttagattcttcactcattcttatggggttgtgctgtataaaagctgtgatttatcacttcttttatagagaattggaaactttgatttctaacattagcaagatgaccatacgcaatttggttaacttattgtgatttgaaaaagcctattttgaggttgtgagaaataatgagggaacctgaaaggcacattgtcttaggcgcatgtttaccatgtgactatggctttccagatggagagaacaaattaaaaattaaaaatgagtgattctagaccttgcctaaattcattgacccagatgagagctcttcactctttcccaatgcatattctcatttactagagagcttgatgttttgttttggatctagttccaattttattatgataaataaatgctatatttaaagataaagattcacaaccagatgatatgaaatgattactaaagcattataaaaatgctattatgccttaacaaaaatataaaggacagtgaaggatagatgcagttaataaagattttttatattatggaaaaatatttgtaacataaaatccaccattttaactgtttttaagtgtacaatttagtggcattaagtatattcacatcgtcgtacaactttcaccaatatctatctccagaagttttttgtcttccttcactagaactctatattcattaagtggtatctccctgttctctcccccgagtccctggcaactacccttgcactctgtctctgtgaatttgactactctgggtacctcatgtaggtggaagcatacactacttgtctttttctgtctgacttgttttactttgcatatcttcaaggttttttcatattgtagtgtgtgtcagaattttatttctttttaagaatgaataatagttcattttatgtatatacaacagtttatccattcgtctgttgatggacatgcaggttgcttctatcttttggcatttgttaacagttaagattttttagatttgtctttacaagggtatatatgattattaaattgaacattctaattggatgaaatgaaaagaaagaaagtatatcagtgataaagtttataattttgatttctttattgtacacaggaaagtgctagatcattttacccccaaatactattattatgttgtagactgcttacttttgatattctatgacataaatagagatgttggagtatacatcatgatgcgtatttatttacctgaagggaaagatggaattcttcataatgcgcatattggatattctgatgaactggacattgccagttctaaactctcatttacgttttgacttcttagtgtatgataatgtgatttaatgaatcacgaggaaccagagggatatttttgcctttttaaacttttagctttgtagtatacattttttctttagcccttcatctgtttttcataattatttttcacttaactagttttatcatattagttttaatatgaatgaaaggccatagtgtttgttatgttttcaaatatgaaatgccctgtacattgcattgcagtgatatggagtgctgtcaatgtcctagacttgcagggaatctgcaaacttgattgaacttttatgagtaataatttagaaagatattaatgtggaatacgtgccattgcattatccgcttcttcctttgtttcactcaatttaaaacaatgcaatacaacaaaacagaaacaaactttgacaaaatccagctgattaacttttgtagtaagttgcctttctacattagtatattttaaatattgaggtatgatatacacagttttgatttctggggttaactagttgaaggctatagggtttaatatgtttctttgtacactcagtgtctaacactagatagagtaaaactgtattcaaaatataccagcattgaagaatagcatctaaaaattggattggagtaagttggatgtcttggaagatctgattttaagatggcagtaacataaaatacacttttatataattgtggtgatgttactgggtgttgtttttttttttttaattctactagtgagtcaggtggctatttctatttgaaagtgaaggttttagatttcaaattcagtatgggttgtagattacatacttctttgtaaagatttcccgtctatatttcgttgctgaatagtcatataaagatggtggaacctttttaagtctctctgatgctccaacaaagaggataaacaacaggatatttttattttatctgatgttcacagtattaggtactttcttttgtagaaagttatggaaattcttattttttgttgccatttgcaaagatgacagtgataatatatttacataaatatactttaatgccatttgtcttttatctggctaatctagtctttttgtttttcctttcttccaaattgttcacattaaatgtaaaaatttctgagccaccttactgtttcttacaaaattgctgtgctttaaattactagagtatgttttaattttttgaacatcattttattactacagctagaataataacccttctcctgtgcatctctcagttattgtaagaattaaatgatttattatgaaaacactgtaaattataaagcaccatatatactttattgatctctgtaagttatacatagttgtgtattgtacaaattgtgttttgttgttgtttgttttttgagacggtctcactctgtcactcaggttgtagtacagcggtgcaatctcagctcaccacaacctctgcctcgcgggctcaagcgatcctcccacctcagcctcccaagtagctgtgaccacaggcgcacaccaccatgcccagctaattttttttttttttttttttttttttttttttttttcctgtagagatggttttgccatgttggccgggttggtctcaaactcttgagctcaagtgatccacccgccttggcctcccaaagtgctaggattacaggcgtgagccaccacaccttgcctgtacaagtttgcaaaaggcagaattttatatatatttcctgtgtattattctaactgggctcttatatgctatcggtattgtagtttcttggacaggcaaacgtttttattgtgttttgtttgtgtgtgttttacttttttaaaatgtcttgggtagttttcggaatctgttttactcatttggtgattataaatttagaagtttgccatgtaagatagtaaaatgttttagatcatttgggttgatttttctgcttctttttttttttttttccattttcctaaacttaggagtaaaactggtttaaaaaactttttgagacactttagaagattaagtggaatggtcatattatactttttcctttggtttttactttgtattaacatgaaggcatatattgcatttagagaaatatgaacacagtaaaatgttttcccatcagcctttcaaatttgttgtatcttgattatgaaagtgttgtcattttaataactagtctaactaggctgtcagctggttcttggaataaggaagctgcttgggcattagtgcttggacctcccactctcttattgtcaatagataacactgaacaatttgaactatttgatttacatacttgttaagtaatttgtatatatgccttctatttggaaaaattatttttgaagtggataaataaaaaaattactataggaataaaagagaacaatgtaaaaattctactaccttagaatgtagtagaatattattttgcaaatttgtaaattgtgattcaagaagtatttttatgaccttcctttccatttgtacactctgaactagatcaaatgaaaatcatcacgagatttttcatgcccatttaatgttttattttagaaagagttaaggagaaaaaaagtaagttgaaacaactgaactaatctcttgtaaccaacattcagaacaaagcttttaaattactcttcatcttctgtgtttcttaggattccatgtgcacagattttattttatgccctcagttcaaagctaaaacacatcaactacccctattatttaaaaaaaagttttttcaacaagagaattttaaacaaaatgtctgttcttttattctattacagaactcaggtgagaatccttctcatattttaacatggaaataatgttttccttaaaaacaacatttttcttgtttagcttaaaagcagaatggaaacctgttctcatttgtacatatttagcctaccctttggcttaccaatggttgagtcatgagcaaaattagtttgtgtatgtattttaaaagtcagatgtcaagtaatcaccttttaaagaggctcattataattagttacatgtatgacagtttactcatgaagaaactgccatttatgtaatttcacagtttaaaagctacatgcttgagcagagtctatgtttctgtatttaaaaaataaagtggattttgtctttgtattaaaacatgttaagtaactatatctttttcatagctctgcttttacaatgatatcaaagcatcaatagaaaggcaaattaatttctgataatttcaacgttattggtatttaatttggagccatacttatacctgataacttgacttttccctttgtttgaggatatttaactcacttaactcacaggctgaaaagaagtagagaaaaaacccagatgttcagtttagcaattaaaaaaggatttgcacttgctgagtacagttttttaaattagacagcatctagttactctttgatctttcatttgtggtgttcatgcctaggcattttaaaactaactaaagtaaaaatgcttactcaggagaaaagacactgaggaccaaggctcctttaataaatggaaggcaactgttattacaggaacataggaaagtattcaaaagatttcttttgaaatcatttcagaagctgcattaaatggttctttcattcctgattctggtttgccgaatatcaccattagtcattaagcacattgctttatcatttcagtctctgtctctgcacatacaactctcacccctcaagctctccactagtctacctcacctttctcttcaaaacttctccaggggccaactttttgttaaagctgtcctatgcaaactcttttactttatatccattacttatttaaattaatttttaccctgtgtttatttgaaatcatttggaaattatgaaataactgaccttaagtctttttcatttatattgtacagtgcttctagtagagaagcactaatatatctatattcctaatatatatatattttgataggatgcgctgcatagatgaagatgagatagctattaactctaaatgaataggcatgaacttttcagggagtcagaggagctatagaaaattcacgtttagctccttttatttaaataatatgtaaaaagtcacatttctttgatgacttaaacctgctgtagttataaagtgcctaaattgtgagtgcaggactcttatcattgaattactcctagaggtcttgaattcatgcacgctgattaaaatatgtaaaaatatgtgaattatcatgtaattgataccatagtgaattaatatcattttgattaaagtcaaatttgtttaaaagttttactgaattcataacagctcaaccaataatattagaaacaccactgctgtcatgtggcaatgcaagtgtttcgacattaaaaaggagtgcagggtggggcacggtggctcacacctgtaattccagcattttgggaggcccatgcaggaggatcacttggggccaggagttcaagaccagcctggacaacatagggagaccctgtctatacaaaaaataaaaacttagctgggcatactggcacatacctatagttccagctacctgggaggctgaggtgggaggatcactttagcccagaagtttgaggcaacattgagctatgatcgcaccactgaattccagcctgggcaacagagcaagaccttgtctcttaaagaaaaaaaaaaaagaaggagtgctgatgtcccaagagtctagacacctgctggactctagttgcctaactttaaagatgagaaaccccggcccaaaggagtgaaatgacccacctcacatcacccagaaagtgtttaacatagaactagatctggttcctatggccctgtaatcatattacttctctatacggctgtggacataacaaatgggaatgaagtttatgagagagggccatataaaaagagcaataggctgggtgcggtggctcacacctgtaatcccagcactttggaaggccgaggcaggcggatcatgaggtcaggagtttgagaccagcctgaccaacatggtgaaaccccatctctactaacatacaaagaattaaccgggcatagtggcgcgcgcctgtagtcccacctactcaggaggctgaggcaggggaatcactcgaacccgggaggcggaggttgcagtgagccaagatcacgccattgcactccagcctggaggacagagtgagactctgtctcaaaaaaaaaaaaaaaaaagcaataaccctggcttagattatcttttatactttgaagtgttttttcatcatcaagaaataaaatgataggaaaacttgtttaatgaagataatgttatatagtgcttatgaaaatagtttcatctattacactattaatttttgattctttagaaactcagtaatagcaggagcatcatttgaatagtactcaaactttttgacattatttccaattgtgattttatttctttataaggcctgagaaataattagggaagatttggtgagtgcctctttagacccgggaatgctaatacacagagttataaaatgaatggcctgcggtcattgaccttcttagttctcctaacccttagttctattttatgtccattatctttgtttttactttgtggcatgtctttgctttttggtgttgctttagtgaaagcagatttatgggagagaggtggaaatgctagtcactcagtttggcttttcgctagcacttcttgaaaatattcagttggtgaatattgaaatgaatgacaaataaaatctgagggttatatgagtttcagtttttaagtcagtcatttgaaatatgtgatgccacagtaactgctaaataagtgactttgtgtttctggttacaagactctactagttcagtggtaagtcctatagccgttgtataagttggtgagaaaagatgtaaagtgtggtacctggtatattgtatgcacaggtgatataaaaataaacaaaggtagaaaaagtcaagtcaggtattcactctacagaaggagagtcaagtcagtgagttgaaccaatgagcaagtggaagaaagttgctgtgagggaagtgatttaaacagttaacagtttcattcttttctatagccaggtgaaggaatcataagttccatgaattgggtaaaaaagttttgtatggtggaaaatgtctcagtcataggcttggctatgtgaatgaaatgattttggttcctttgtagtttgatccttgatgaacctgatattcagtgtaaatgtttcactaacaatatgtgtacattgcagtttggtagaagatgtctttctacctacagcaaatgtttttatagtatatatggctaatactatctatgagtaccttagtaaaatatctctaaaatacaggaaaacctttctgctatggatataaaattatttcatctcaggagactttctagccttactactctcattttaattcatcatattattttgaagaaactactattgaaacacaagacatgaaaacaagaagtgaacagaacatgaaatgaggagcttagaaaaaaaggttaacaataagtatgttgttgaaatgaatttgctgttaatgccatctgaaaagttaaagagttgtagtcaaccttatgaattcattaattaatataacaactttgttgaacacttactgttttttaggaactgaggataccaggtgaacaaaagagtttctgtctttataaagcttataatctagtggtggaacacggacaacaaacatatacctaagatgtgcacgggtgttaatacgtgtgtcttagtctcttcaagctgctttaacagaatgccatagactgggtggcttataaacagcagcgatttatttctcacagttctagaggctggaaagtccaagatcaaatccctagttgatttggtgtctgatcagggcctgcttttttgttcatagatagataccttttctctgtgttttcatatggtggaaagggcaagggagttctctggggcttcttttataaggacactaattccactcatgagaggtctgccttcatgacctaatcaccttccaaaggccccaactctacacaccgttaaattgggcattaggatttaacatatgaattttgaggggacacagactttcagtgcagcaaagataaagtgctatcatggtgatgtaatagaaattgattcagaaagaccagctttggatagggtgaccaggaaaagtttctctgagaatgaggcatttgaattgagactcaagagaagaggagcagccagcaagaaaagagcacgtgaggcaaaagaaatggcaagtgcaaaggtcaggaaattagacagaatttgccatgctggaagaacaaaggaaaggcccagtgtagttcatgttcacttagtgagggtggaagagcataactgaaattggattggtaagcaaaagctatgtcatggaaggtcctccggctcatggtgagaaacgtggattttatcttaagagagcatggtcagccaaatttaagcagaggcataacatgatcaaaattatgtttattaaaaaattgttctggattccctagggtaataggctaaggaaagatgtaagaactgtggaactagttaggagactattgaaataatgcaggaaagagacgatgatgatgacttaggcgggaggttgtttgttaatatataatccactgttattgtggctgcaaatgcaatcctgtgtctttccattgtccatttaaaagcaattttacaaatatcacttttttaaaacagtaactacaatgccataagagcctttttttgttgtaaactactgtggcaagaaattagttttaggtagagaattgcatgtgtacttagctgtgattgtattaggactgttctttggaagacttttattaataatgaattaataatagtgaaggttttctaagcagactctcttgcactgtagtaagtgtttcctatccattatctcatttgatcttcactaaaatcctgtgacatatgtgctgttattatttccatgttgaaaataagaaaactaggggactgagaaggtaaggaacttcccagggtaacaaagataaaaaattatgcatcacaatttgaacctagttctttctgataccacagctcaaaccttaaaaaaatctaaaataccttttattgagaaactacttacttataataaaatgcacagatcttaaatgtattcagtggattttcacagttgcatacacatatgtagctacctccccaaactgaatacaaaatgtttctagcactacagaatgttccttcatgctccttctggtcagttttcccccaacatcctcccactctacagactactatctggttttgatcaccatatgttagttttgccttttcttggacttcatgtgaatggaatagaacaatcataatttttggagtctcatctgtgttgttacttattgtttgttctttcttatggctgaggagtagtagtattttattatatcaatataggtccatttcacctgttgagggacatttagattgtttccagttcttagcaattttatgaataaaccagctatgagcatatatgtactagaatatgttttcatttctattgggtaaatacttaggagtagaattgatggattgtaaggtaagatgtatgtttgcctttttaagaagctgccaaacagttgtctcaagtggttgtaccatttcagtttcctaccagcaatgtatgggaattgcaattgctgtatatcataccagcatttggtattgtcagtctttgttttagccgttctagtgggtgtgaactggtatctcagtgtggttttaatttgcatttccctaaagacaaatgatattgggtcccttttaatgtgtttagtggccatttatataccttttcttttgaagtatttaagacttttgccctttaaaaaatgtgcattatttggatttttattgctgatttctaagaattctttgtatattccagatacaaattcgtgtcagatatatgtattacaaatattttcttccagactgtggtttgcctattcgtttctctagtagtgtgttttttgatgagtagaaatatttaatattgattgaagtccaatttgttttgtctttcatagttactgctttctctttcttaagtaatctttgcctgcttcatagttacaaagaatttcctcttgtgttttcttctagaagatttactttagctttagatttcagtctttgattcatttagaatttacttttgtgtataatatgaggtaaagagcaaagttctttttttttcatgtttgtccagttgttccaacatcattattccctattgaattattttggtgcctttgtcaaattaattggctatgtatgtgtgagtgagtttctggacactgtactgataaatttgtatatccttatgccaatatcacattgtcttgtttactgtcacttaatcaggaagtgaattttattctttttcaagctagttttatctatccgagcttctttcatttttatataaatttacagagagttgtcaatttctttaaaaaataacctgtcctgatgtttctttgaatggcattgaatctctacattaattttgtgagaatgaacctattaatatggagtccttcaatctacatacatggcattatctctcatttatttcatagcccagaataatgcacaagaaagaacacatgagcggagactagttgatcaattacctctagcaaacatagggtctcctctctcttttaaagtctatttaaacaccaattctaagaaaatatgcgtttggtgttaagagagggtatctcatgtgaaagtgagtgagctatacttccttatattaagaggagcggttaaaacttcagaactgtatcgggtttcaaaaaaaattgttttccaaaaaaatgtgcagccctttgactagtaatatattttctgtactagtgaaagtgtgatctctcgtagtttaattcaattacctaataagctgatatgtgatcactagtattctcataaaacatcacataaaaagcaagcagtcgtggtcaggcttggtggctcacacctataatcccagcactttgggaggctgaggtggcaggattgcttgaggcctagggagttcaagaccatcctgggcaacatagtgagaccccatcttgaccaaaaacaaacaaacaaacaaacaaacaaacaaaaattagccaggcatggtaatgtgtgcctgtagccccagctactcagttgggtgaagcaggtggatcacttgagcccaggagtttgaggcttgcagtgagccatgattgtgccactgcaccccagcctgagtaacagagtgagaccccaactcaaaaaaaaaaaaaaaaaaaaaaaagcccaagcaaaacaagcaatcttatgtggaggcagtcagaaagtgctttaaagtcgtgaatagagttgcattttctaagtctaggggaaatgtgtacaacaaaactaatgagagtaaaagcttttgggacttgaattttccagtaagtcaatagggttcagaacattcatctttcaatacttaattttggaggagtaatataatatgtacctcagaggattactgcaaggattagagcaggaaatctatgacaagtgctgagcacattgtttggcataaagaaggatctcaataaacttaaatattttcatctttatctagatccatgacaagttctgggtgcaggggcaggtttttaacttgtttcatctctatgctttcactttagaatgctgttgttgaccatagtattcaaacatcttgcagaagcaccactttcctcaaatgttaatttggttttgatttctactttataggcagatatatatgtatgtatatggtatgatttacttccttagatggtatatatatatctccaaatttagtgtccatttaacataaagactatttttccttttactggacttgaaactattggaacttagaagaatgaaactcagtaaatttttttttctaaatccagttaattacagtagttaatttacagaccatggtatttgttattaacactaaaatataatttagtgttaggtttgttgatagtacatttaaatatacttaggtttgttgataatacatttataagtgatttgttataagcagattaaacctattagcatcaactagaagctacttgtgaactatttagggcaagagaggtttaccttacattagtggcttagaaaggccagagggacttgttcctttataggcaaagtaaatttgacatagaacagagtgcgttcactttttaaagtatattttatattattaggagtaatttattttcattaataaaattcgataggctagagttacaaaatgaaattgaaaagattctttttcacaccctgtttccactctgcaaaaatagttgctggttatctattagtagtaaactgtgtatctttacataattatgtgggcattcatcttttttagcttaattgctaagatatatacatagttatatatacacatgattttgatgctactcaatctgagacccttcctcccacaatctattttcagaattcttacatagtttattttcatttgatgtagtgcatttctagttgcacatcttaagcctattaaattaaaatgggttttaatgcatatctatttttaaattttctgagaaatggatcctttggaaattaaatcgctgaatggagaaaacgatctttatagctaaatgcgagataaagtaaaatgaatgaaaaaacagatttagtatgtcaaagtttgaaaaggcaaagaattttgaccactgtattggttaaagaagaaattttaaaacaaaaaattataggagaatatatatattgttggaagctgttataaaaagaaaagttatcatagtgttaaatgtatgtgctaaatgacctaataacaaaaggaaaaaagatattatctaacgttaccttaaggctgtatgataacagaaattaaccaaggaaagcaagaagaaaacttataaagaacaaaatacaaagacaaataataggaaaaaatcaaaagtatttacagtagaaccaaaagccgcttatttcaaacaaataataaacaaataaccaaaggcatggactaaaaatccaagagattgggaggctttttttttgttttctactttattggtgctttatgcctagagtatagatgtacctggctggcagtaaatgctcggtaaatatttattaaatacattaatatttcttacatattttaatagattaattgaaaatgaaagcaccatgtaataatagataaaatattaactgttataagttaatattgtatacatttatgtattaagcaaagtatacatctcaattccaaacataattttcagagtgaaaacgatacagtaactagtaaaacaatatgccgagaatcgtaaaaagaaaaaaagtataattttaaagacttcaataacaaataattaacaaaacaaatttgtattttcattttgttgtcgaagcccacagttttatataaagtaatccaaaacatacgaaaagtagaaaaatttctatttcattttatgaagaaagtctctttattccaaaatattaacagttcacatgaataaacacagaatccaaaataagagcaaatgaaataacatattgagtagtgttaatatcaggaatgcaaatctaatttaacattaggaattttattaacgtaatacgtaatataacatcaatatgttatataacaaaagtcttaccctgataggtattgaaaaggcaattaataaaatttattcacttcataaagaaaaagtaaatattaattgcagaaacagaaggtttttaaaaatactttaaccttgataacaatcctgtaaatttagtatccttcagtgtttttctaccccattctttgtatgttgcctgaatgctacctatgtcttttatggtgagtaatgtcatagtcaaacagttattggaaatgtataatttcaattggtataattttgctcattttatatatatgtatacatatacacacatataattttttgcagagttttgaaattgttaattgcttataattttcaacactggccagttagcccaattcagataaggagtatagcgtgaaacctcactgatttattttactttgtaggaaaagtagttacaattatttttagtaaagtggccggatgcagtgactcatgcctgtaatcccagcactttgggtggccaaggcgggcagatcacttgaggccatgagttcgaggccagcctggccaacatgatgaaaccccgtatctactaaaaataaaaaatcagccaggcatggtggcacacgcctgtattcccagctagttaggaggctaaggcatgagcatcgcttgaaactgggaggtggaggttgtagtgagccgagatcgtgccactgcattccagcctgggtgacagagtaagactctgtctcaaaaaaaaaaaaaaaaagttatttttggtaaagaaattcatgaaataatattcagtaagcttgtgtttagacactgtaatcttaatgattaataaagtaataaagcaattgtaatttttttgaaactcaaaaaattttatatgtgttttctctttaatcctcaaaacaactctttcttaagagttatagtattattttcattttgtatatgaggggtctagctcagagataataaattacaaagtcgttagagaaagagattcttccccatttttaatatttccttcaaggtaaagggaccttaattagtgcaattagtgaccttctctctctctctcctacttcacttccccttcatctctgctttggtgaaggtgaaatagcttaacgtgattgataaatttgggaagaatgtattaggcaaggggttttggaacaggcttaactgcaaggagcaccaattgggctctgtagtctagaggaactagagtctaggtttcaactctgcagagggaaagctgggttctggctgcatgaccgtacatcttgttttgcccaggacacttccacttgatgtcgtccccaatatgattattcataacaccatatttcactcccttgagtaccccagttggaataataagctatatgttcaccttaataatcctgcataattctagggttcggtattaagaaagcacattgcttgcatataaataaagagccgtgtactttaatattgtctttataagtattattttggcctcagtcagctactccattgttttatttctccatttctgaatctgaggagggaagaggagcatttttgagacccagcaataatttttgattagattagattttcagtgttttactgctttagtaaactttctaatgtactgtgccattccatatgagatatcaaattagaggtcaatttaagcaatttaatttccaaacaacttactcttttaagttatttggcatcatgaagacaaataagttgatgggctattttcaccttttagttgttttggtttaggatttgagaactttggaggaatgtttgaaggtttaatgtagggaagaaaagcaaaaaactttttctatactctcttaagtttgtacatggaaacctgtgaattaaactgacaatcggtaggttaacaagagaaaaatgaatttatgcatgcaacatacatatacatgggcgtgctaagtgatgagtaacttaaagggatcattagaatttggagtttatattcctaacttagtaggggaaaggcagtggggagaaaaggctcctgtgggaagaacaaataggtttctttaagaaagacaagtgggttatttttggtgaacaaacagaagataacatttgttacaatgtttgactgcaccagtacaagtggtctttatatcgtcttagggccagaaaatgcccccagatagaggatttatgataaatttacttttgggctctctgctgggattagaagccaccacaaagagataatttacggcagtcctcatttgttagaagtctttgcttttacttttattcagataagagaaactctgaagaggcttgtgtatctgttgaatcacagatgtcttcagcttaaaataaaatttataccaaccatggagtcccaagtgggtccccacatgaacattggtattcatttactgcaacactctcattttccagcttaggaaacgagggtctggagatgtgacttagacaaagttacatattgtattagtgacacaattggttgtagaatttcccagtcctcaggttcctgggtaaagtgtttttaataatatcccctctctgccttttagggtaggaatagggaacaatcagtgagaattatatttaggtagctgaattagaagagtaaatctgatgtttttatgaaaagctttatttgctatttcttgaatatcaccttaatatctcaacttgatctgtagaattttgatcacaagttacctttccactctcttattactagtaattaaattgaaaattcacctctgttattttgtcacagcctaccgcagatgattatctctaatgagctccttaggtgcagagcctaggtttattccttcctgactgcttagtagtggtatttatagaagtagcgttaaagtgagtaagcgtatgtaattcttatatttacctaagtgaagtttggaaatgaagttttttatgtgtatttcagcctgtttatccttgcatatgtaaaccaattacatcttaacatttgtttctggagaacaggccagaaacaaaatattcacttgtacttaatatgttgtaataatgggcatattcaataaaatatgcactggtaatacaattgggcatcatatctgattggatgaaacagaatatgctaaatgtgatcatttttctgtcacagaatttcatattgagaatatgccagttattttgaagtcagtatatttgctgggattacttggttctgcttgaaaggatagtgggatttttttttctgtgattatgatttctattgttaaaattattattttttgcttttgcatctaaatatgccctttcataagcagctgaaataatctggtcagacaataacccatttctggttaatttgatattagcttttttttgaaatttgaggatactttttagcatttatagatggccaatatcagattcaaatcaccagtcttcttaagaggattttaatgcattcccacttttaaatattctcagtatgtttactgctctcagtagtgggatgtgttgattctgaattgctaaatctattagaaggcgtttttttaaaatgtgtgagtgtgtgtgtgtgtgtgtgtgtgtgagaatgtgattgttgattttctttaccaaaaattggtatttgattagagatgggaaatacctttgagtacttttaaaaatgcaacttaaatttggttactactactgagttgttaatcagaaccctttaactggtggcacaggtaaatcatggccaacaagacctgtggccatccccaaatagactaatgatttgtgaccccttcaaatgctagacatttgaacaattaatattatctgagaactgttgatagcaactcggcttgtcatctgctatcatgagtaatgtagctttgcctttacatttgcaactctgttgtccaaaccaaaatttcacagttaaaatctctgtgatccttagaatataatttagtattattctaatcaatcacctctggttataggagcctgaagggttttaatcttcaacttcaagctacttagctaagtattctttccagcttcttatcagttctgtagtctctctgagttctgtatctttctattcggttacattttaggtgatgttttagatcccatagagatcagcgctttgagtaggtacttggcttcattattcttttatttaatttgggatcccatataataaaatgtgactaaacttagggtttgaactagatgttaaaagtgagaacagtgatcttagaggtttcttccttccccatcccccaagggggccttaaatttttagagttagcttgatagtgttttgtgaatcatacgtatttagctagttaactaccagttgtgttcatttccattctgtttcaaagtagtgctttgaggattgtcaaaagacaaattttcaacaaatttagtttaaagatctaattggcttttaatagcaattcacgaattgagtagcatctcactgaaaaatttagaaaagttgctctgaagggcatggtagaatggtcagtttttataagatagcttgagcaagaacaggaaaacagcataatatgaaaagcaaattggttaatatcaggttacttcaggttactgggttaaagcagaggggacttaccatgttggccagaactggcctatttgagaatttggctatcatctctctcctgatttctgaacattagtatgagggactccattttggtttggtctattccgttgggtcctagtacaggatctcagtccaaatcaatggcttcctataaattttatttaacaggaataaaggatgcaagacatagggaaatttcaagatgacaaacgtgaagctatataaataatcacataaattattcattaacagtttatgtttatcttgaatttactttgttatcactccattttttacttgagcatagatgttagcatattgttaaattgttatctatttcattcatttttaatttagattttcactgttttttcttaatatttagtagtatttaggtttctttctcaaaaaaatttgtcactatatccttttgtctaaaatgttgtctaactttagataaaagcatatagtgacaaaattttcttgaaaccacctttgcaaaaattatagctgagaaaattattacagtgaaaaagattggacctaaccaactcttatcttgcttctaacttccaagctgtccttgttcatccctgggcataggccgaactaacttcgggaggaacttagtttatagtttagctgtgaaacaaagatgaaaacagccctttcccaaacaaaacccttccctgcctggggactagagtgcctttgcaggactaacaaacgaactagccacaatattagaaattatggtttgggagtcatacagttggaggctgcaagattctaaaccttcccaaattgctcctggtgataacatcactattgtaaaacctaagatcatagtttgagatattttgcagaccctgcactgatggatcatctggcatcacttagattgacaaactggctcatctggtcttgtggccaccacccaggaattgattcagtacaagaggacagcttcaactccctgtgatttcatctctgacctgaccaatcagcacttcccactttctgacaccctacctaccaaattatccttaaaaaccctgatccccaagttttggggaagactgatttgagtaataataaaactctggtctttattattaagtagtaatacaactcaaataagactgatttgaataacaataaaaatagctggctctgtatgaattaaactctctattgcaatttccctctcttggtaaatcttctctgtctaggcagcaggtaaagaaaacccattgggcagttataatatttatgtacatcttttgtttctattctgcttgaaaaataattcccatagatttgctttaaaaatttaagtcttctccttgtgccacttaacagtattaattttattgaagactgttgtgaaaaaagttaatggaccctcaagagcatgatatatctaatggttaacagcataaataactgtgatatagtaggttatactcttaggtctatattataattgaggtcagcaatctaactttaatatagttatattaatataattctgtaagtatagctttaaggtttaattatttaactaagactattacgaaggaaataaaaatagttaagcatacgaacaattctctctccagtaatcaaagattttaggaatgaaaattcaactctctccaccatctttgctatttaaaattagagaatagagatttagtagaatcatttcaagtggtattcacaaaaaggtatttgcctttaccttaacactcacttttggagataaagattttatttttcctttgcttatgtacaataaaagtacagttgagttatatatttataactcaagcttcaggcagtaccaagtcctggaattttttaagaattcaatcatgagcattctataaaagttgattatacgagattatccaaaaggttcctgtaaatcttactttatcacctacattttaaaaactcatattgggtagagaccagcaaagaaagtttttctgcaagtaggatttttctcttatttttttaataaacattttctttggctattgatactgtttctaattgattttataaatgaatagaaaagataagagaattctggaaaatataaactactcacaaattaaaatttattgctctttgagacatctgcctttccctcttaatttgtgatgataattgctgttctgagagggacagaaaaaacatatcccagtggcttatttagcaaaacactagaatgtttatttgaacctgatcgcttttaaaacttggaaaaggtaaaataggtcagaaagatgtaatcttttatgggaattccttcaaacatttaattcccaatattaaatgaaaataattggaacacaaagagcttggaacactattcacttgttcaattttgtgttcataactgtatcattgggttgtttttgttttggtgtgcaaaatattcctaaatggcaccaaacatgaatttgtagggattcagttttagaaacacataaagctaaacattctgctcattaccatgtgtcctcctttatatcactaagttcactttgctggatgttactacttttatgcagtaattttattaagtatatcaaaggaaatatttcaagttagagatgagttctacaggcttgtgtgtatgtctttttttttttttttttttttggatggagtcttgctctgtcacccaggctggagtacagtggcataatctcagctcactacaacctccacctcccaggttcaagcgattctcctgcctcagcctccagagtaactgggactacaggtgtgcaccaccacatgtggctaatttttgtattttttgtagagacaggggttttgccatgttggtgaggctggtctcaaactcctgacctgaagtgacccactcgccttggcctcccaaagtgctgggatttcaggtgtgagccaccatgcccagcccaagcttgtgatttgttcaagattcatcaactgacaagaaaatgtcaatcaagtaacagactactttcttttagtgtataatagaatgatacttggctcttgacatttgtcttttttttgtacaatactgtcatgacagccaacacacttgtcttttgattagtaaaagctgggggcttgatagaaatcgtagactaaatttaactagtacagcaaattgagttgcgatccatatctgtgaatcttagaaaatttgttcttaatatttttgtactactgtgagcaaatgactgaagtggagcaattgtagagaaggttgatgcaaatacatacttagaagcctagtacctgaaataaactaggagcaaattcttcagtgacttcagtctccggtgatgtggcacaagtatggctttttctctgtttctggcattaggcttttcagagaaactaatgggagtaatggttctctaggtgtgtaataattttttatgactcttgaaattactccaaaacaaggtctccctatcagtgatttgtggaatagtagtgccctggaaatgccagtaagttgttctgagaaaagagaaattacttgatcaagcgaatttgagaaactttttgttacacaatcagctgtatactgtttcactgtaggatatctcagagtcaaaactaatgacatatattgtgaattgctaagaaggaggtatacagttcacagcatttcccaaaccgacttgatcctggaaaccacctataacatctagtaagatgagaatgctccatagaaattaattgaggaatgttatctaaaaacctaactatatattaatgtatactttctagttactgttgaatctaatttatattcaaagtttaaaaaatgttggtagaaataacttgataaaattgaatggtcttttatgatataaactcatagcatatgagaataaaaggaacaccacttaatagtaactaccaaaaactctaaaaaataatatttaaaaatgaaacctagaaacatttcctttaaattaaggaagaagagaagaatgctcactgttaaaaggtttcatactggaaaagaagaaacaaattctcaatatttgcagaggtccaggagaatgtacagagcaatcttcaatatcaacaaaagttgctagatcaagatcaatataaaaaattaagtgttcctatacacctaaccatacagttacgaagggtaattttaaaaagagaccatgtagaaattacataaaagaatgtaaagtaattgagaagaaatctaataaaggttgtagaagatcttttatgaagaaaattttaaagtatcattgaaagctatatctgtatggatgggtaagagtcagtatgtttaaaatgacaagtctccccaaattaatctataaattcaataaaattttagttgcaaaataccataagggttttcatataacttgataatgtagggaaggtaaaatttttctctaaccccctgtggtctccagctggtactgatataagacagatcaacaggagaaaaacatacacattttatttacatgtgcctgtaaacaaaatgctctcacaagaaaaatggagacccaaagaaatgactagctctaaatgcttacatactatgtggaacaaagagtggcaattgtagaaaagtgactaggaagagaggggttagtttaagaaggtctgtttgtacagatttctttcagccttaactcccctcctcttgtgatgagactatttctcttctcctggtatagggaaggtatgggagtttcaactcctgctttatgaagaaaagggaaaatcagagtgcatctcttgcacctgctgtttttcaggtgcctttagctcaaaatgatcaacatgtcaaatggtgtattttgggatggcatcctgaacttgttcagtagataagttgatttatgtggaataataagggccaaaaatagcaaagataatttttaaaaagaagaagaatggagtgagaagcagcggaattggagtgtaattgttataccagatacccaaacttacttgtggtaaataaaagaatgtggtattggtacagggaaaaggaaacatactgatatggcagaatagaagagagcactgaaaatggatccacatatgtgggaacttgatgtttcttaaaggtggtatcataaactaatagaaatagggaccactgaatacatgataaattagtttatccacagggaaaaagataaaacagacactatttgaaactttaccccaaaagactaaatatgaaaagtaaaatggtaaagcttttagaaacaagttacaacaagttatagaagagtatctgtatgatatagtggtaatgaaggatatatttgttttaaaaactcacaaaaaacagatgccatcagtaaaaaattaatagaacttaccacattaagatacaaaaaaaaccaaataaatgcacccccccaaaaaaaaagtttgtattaccatgaagaaagaatatgctacatgtaaatatgtaagccacagcctgagagaaaaaaaatatcacatgtgaaggataggtacccaggctattaaaaaacaaaaattctgcatattgataagaaaaagacagaagtccttatagaaaaaatgaggaaaggataagaactatcacataagaattgattgaagttgtcagtaattatatgaaaagatgttcaatgatatgagtaatgttaaaaaatgcaggttgacaaaaagagagtccaggtcacatccattagattggcagctactggctgccaatattattattaaagagtcatattaataatactatatataatattgttatactatatataatattgttatcatattatatataataatgttgttatattacatataataatgcaaactatcacaagtttacatttaattatatataatataataatattaatattaatgtcatgtaacacttattgttggggaaagcatggagaaacaaacttgtacccatttctgcaggagtatagatttgcaaagtcactttgaaaaccatttgataatacctagaaaaattgacaattttcattcatatactcaaggattttcctactagtttacaatgtaaggaaactctcacaattgtgtataagtaggcctgtacagagttggtcattcaggactgtttgtaaatgagggaaaaagtgaacacaatttaaccatctcctcagtagggtaatgcctaaaataaactgtgatatacagttatttagtaaaacattattcaatggttaaaatgaggaaatttatttatttatatcaacatggttaatctggaaattagagtgagtaattaaagtttcagaggcacacttacagtataataccatttctatgaaattttaaatgcagaaaacagtattgcatatttgtggatatacatgtatagtgaaagactaaaaacatgcatgggacttatacctatgcattaaaaaaatattttatccctaggtagaaaggaaggaaaaagatggaggcttgagggtttatgtatatatatgactttttttcccttttttttctttttggaaacaaaaatagggaaatcttaatattggtttaaacatggcggtggataaatgtttttgttatatattttttacgtgataaaactttcactagaatttaaattaaaaaaaattcaaagtattcacagatttccatttttacaatttcagaaataggcataggaagaggagccgttttcagttgatcactgtagctagtgccttgaagatgaatgtgccttgaaactttcaaattatgtaatttgaggtgaatgaagtaatggtatatagcttttgctgatttgttaatatttaattgggccaggaacagttcaagtctttaaatagaagtatatttgtacaatatccagcttagcatccagcttgggaaacactatttcccatcagctttaaagcataagtctataaataatatatgaatttgaaccttattctaaagatagtgagagatttaaaataacagtaaacaaccatagtcttcctgggtcattcttggacacatttttgagtaggtcaaagttaattcttggctattctgggcttttctcaagtttgcttctatctcttagagattgatggctgcatcaataggtgatacattcacatacttgaaagtataagtgactcaggatgcataatgagttttatctctaaatgatacttagattttaagaaagttcaatgacttacactaaaagaatgaatttctaaaagtggaagtttaaggcttgttcattggagtggtgggtgggggtaggtgtttagacaagggccttcaccagacctcccagttccatcccctagtgagtggctgctctacttaagagatcagtgtttgttctttttacctaggaaaataaagtgagagaacaagtatatttaatgaaaatggtaacgttattttaaaaaattataaattagagaccaattagaaatcacacaacctcatcactctgaaaaatattttgtattcagatgttctttctaagcatagaatgaagtctaagctgagatgtcaccgtggagagttagtgaaggccctgtgataggttttcaataagttaaatgtagggtccatttcactgtgatagccgttataagtaaattcctagatcatttattttcataggtcaacataaaggctagttccatgttgatattactctttgcagaataaccatttcattgtaaaccaatattattgtgtcatttcaatttacttttgcagttgctttgaggccaaactttatcaactcatttaaatatctcttttagctcaaataggcacaatctccttagtaaaaatatgttcacatctatacaaatagatattttagcttttagtttaggttttgaatttatttctcagtattattttcttttttaagcttattacagtttccattgagacagttggggtaaagggagatttagtggcattatctatgtgcatgttagtattttaagaatgaattgtgaaggataagttgggaacttctaaactgtgcatacatataggctaatatattttcaactttaagtatgtatgataagatagataatataatgaaacataatagatgatgtatatagtatatttatagatttactaatatataattatatttttatatttaataaaatataataaatttatattttttgtaaattcattgaaatctaaaattcagtgaattttattcaacctaaaggctctttaacgtatgtcaggtattagaatttaaaacaagatagcacaactttgtagcaattccacgagattcagatttcaaagagtttgagctagaaagtatttattatgtagaacacattccagaattagtccaaagaagacatgcattagagaaacattcgatctcttactattgaagttgtgtacttgatagatacttgagagcttattaaagcagtttcccatttttcagtatgaagctggtatacctaaatcagcaatctttgattctatattttctctgaaaataggacaaactcaccttcctattctggtattgccttgcctagctgctgaagttgtagtggcagcaacagctgagacagcagcaatatatcaatagaaatagtctgtaggatggaactgcagccacacacaagatctaagacttgtctaaaatttaatacagacattgctttgctatatcaatctaaataattatcccttaattatcatccctttattttcaatgtttcttgaataaaaggaaaggaataatcgattgatagctgtgattgttgtgtgttgtgaacagtagttccaggtgtgtgccaaagagcaaggtagtttattgtctttgtcagaggttagaaatacatggtctcagatagtcctaggagctcagaaggtctctgtattaataattttagttccttggcttttgttcttccagtcataataaacagtttgcatatcttaaatttgctccagaaacctgatatgaatatcctctaaattacacaattgtcctttttcactgggctggttagtgatgagtttccagctcaggtcctatactctaggaaataaatataacttaacctgctatcatctacatatatgtcattgagagcttttgacaggaatttattcacaaatatgtaagtcttgtcaaaataccctagtttttaaatatcctgaaatgtaagaatctcggaaaatctgtagttctgagattctggtgaacccagagcgattggagccttaaatagttttcttccaaatatcctaatttctttctctgttttgtttctcataacagaatcaaaccatggaaataaatgaagttaaagataaaagtgcaggtttgccagtcccaccacccccgtgcctggcattaaattaaaaataaatgccattctaaaacctggagctgcttttgctcataaaagggagttctacctagttaactcctgtttattttctggggcattaatattcagtgtgaagtctctcatatatatatatatatatatatatatatatatatatcgttcacggcttttagcttttcactctactccacatatgaaagcctccttgaaagcagagcagattggaatattgtttattcatatagttaccttatggcatttggcatttctgactctttggaaccagggacataggaatttggaagattgtaagatagtgattctctagtacagcctgcttacattcagccaatcagcccccaaaatatttaaatcattccaccctgtacctttcaccttctaagtacgtatacccatatgttaaaaacaatcttcccttttctactaattttttctgtttgtcttgtgttgtaattgaattgcaagatgtgggacaagtattttaaacactttttttttcatttctggtcctgatataattcagtgaatattaatatatttaagttaaaacagataatattcttaagtcataaaaaatgataatcttaatttatctggaattgagaaaaacatttattttggattacaagtaaaatttctctgcaggaaaagctagattataatgtggatactcaagagatgattttgagagaatgtaatttatttcacagatgatggagtgatttattcttaaaaactaaatggaaaaaggattttctgtctttatagccaaatcagcttactgtatcaatatttttctgtccttaaaatttcacatagtttagttccattaaaaaaacaaacaaacaaacttctgttttgggccaggcgcggtggttcacacctgtaatcccagcactttgggaggccaaggtgggtagatcacttgaggccaggagttcaagaccagcctggccaacatggtgaaactttatctctactaaaaatacaaaaactagccagacatggtgcatgcctgtagtctcagctacttaggaggctgaggtgggagaattgcttgaacccgggaggcggaggttgcagtgagccgagattacgccactgcactccagcttggggcacagagcaagactgtctcaaaaaacaacaaaaagaacaacaacaacaaaaccttttattttgaagggaagaaaacgtgttcagtttgatagcacatttatgagtagagtgtagactgtcaggaatatttagctttttaaaaaagattattcctacagctgaggaaaaaaaaactttctcccactcttgatgtgaaaattactaggtgatttgcatgtgagaataattttactgtagcatctgagaagtggtctgaatgaagaggtgagcccagttagttaccaggcaacaggtggctaaaggacatgaactctggcaaacatcaccagttcctcgttcattttattgtcagttggagactctccagccatgcagcccagttcttgagaattgtttatagaattgtttgcttctgaaggaatttgtaaccacattttgtttgatgaatactaaacaccttagaagccttctgattatactggcattgactttgtcatgaaccacttaaaaagtgagccatgatgactagtaacacaaatgtgggacccttttggatgaccacaatttgcctataatatagaaatatggtgctattcaaaaaaaagctcagacctgtgaacaccagggaagggggagagaatgggataggaaattacagactggagaagggactttttttttatggttggtatacttatactttcccacttttcagttgtgtgaataatatgagcaaaaattcagggaagtttcatggtgttgtatcttcattccttttggaaaattcaaaatcttatgtattgtattcaccagagaatggaagggaactaacaactgagcctctaatattccagagaattggtatcagatgctttatgcagattatctcatttttattatcacagcacttagacaggtagatactgttacagtctccttctacagacaatgccactagagagctgaagcattctgaggttaaaaatcttacctattgcctcacattatggtttgatttacagcaattttcgttctattgccccctatcatttggagtaattgactgtgttcaataatatttaatagttcctttatgcattttagtatatttgtcttgataaagtatatgcagaaattggagttaaaaaggatcttgtaaatcagattatagttctcactcctgtacttgagccagcctaggtacattaaatatctgtctagtttaaataattctagaaaagattccacaattttccttagtaacccaaatatgtcattgccttgatttaagccattttcttctggtttgtcctaaatagagatggagaacagctggttaccattcccaatataataacccatatatttctagaacattataaagcattccctcaggtttttcttcacagcctgactccttgtatccttttgatctttcttctttttccaaccctttcatcatctgtgtgggcttccttcctttttatttctctgcattccctttcagatgtggagatcataactgggcatggatagccagcatgagtcaagcagtgatgagtaaaataagaaacttacctcagagtttctaaactaattttctatttatgaaccccagtaatgtgcttgcttaaaacacaacgagaatggtggctcgctatcatatttcacttgtaggtctgctatggtacaaggtgtgttttttctgctacatttcaattctcgcacgtggccagcctttaccttgtatgctgtgtcttatattccagaacatattattttgcaaaatgacaggaaagacttgcataagtatgaaggatattttgatgtgaaaaaaaaaactttttaaaagattttaatgtattcaaagtgattgtgttgttaaaaatgctttctttctttacactgggaaataacttatgcctgaatggttgataatgcaactgtctgaatcatttcattaattacgtagagttttctaatatactaaccccattttaaaagcacttctaatccaccaaagttatttctttgtatctattttatttgctgatgggaatttaataagcttgccatttattacattacttattttactaaggaaatgttaaatagcactaaatagtaggcaaagttgtagccataccatcctttaaaactcactctaaaatgtacatattttgttaaaatagtgagccacatttccttttcacttcagagcctatatagtttataaaatctcattgtttcttaggagttactagcatagtacccctttcagttttaacttttctcattttgttactccacgttatgtcagtaatttaactttttagttatagacaaggggtcaaattatcatttttatttagggaatgtcctattttcacatgacttcaacagaatagtttctgttagtgcacctaccattttcattttgtctcttacagtgttacacatttatagatttataatttgagtttttcacacatgcttttttagtttaattaaaagttcatgttcattcagtaagtgctgtacagtacttgagaggatgttcatcactggtttaataatactagttcagtccttgatagatgttagcttttctccataagtcctacaattagccattttgtatagaaaagaatctgtggctcagtgcagctattggaaaagcacttcaaaatttcttaactactttaccagccaattagcatctcctttactcatgaggagcaattttctctctttagccttgatcttaacatgagacacaccgcccgtgtctctgtctcctgcccccaccacatgcagaaagttatatggtgttacaggtttttggagctcttccccacaactatgccagggttccttgctttgagaaggcttcactgagactgatagaatggttttcttctttgcattcttgatgcatacattacgtccttttaaaatgttgaggaggcttattagcaagagaaatatatttcttcccattaaatttcattcactatcaatttttaagaaaatacagtctccagtctaaggagatctatggagaaagcaaaagctacctttgaatagtctcttagaagagcacatttgttaaaactttttattttgtaacaattgtacatttatgagaaagctgaaaagatagtacagaatgttctcatatacctagcgcttagttcagaactaaaaacttttcaagaccagctagcttacattgtctccttcttgaaggccagatactggctaccttttaaaagcaaatgcaaaggcctttgggtggttccttgtgtgtaggtagttgtagtgtggagtatatagctgctgaatgcagaaatcagagaacctgaggcatctaaacaagcttttgaagtagggagtgctaggctccatttaccacttttctttttttttttttttttgagatggagtctcactttgtcccccaggctgaagtgcagtggggtgatctcagctcaccgcaagctccgcctcctgggttcactacattctcctgcctcagcctccagagtagctaggactacaggcgcctgcctccacgcccggctaattttttttttttttttgtatttgtagtagagatagggtttcaccatgttagccaggatggtctcgatcctggcctcccaaagtgctgggattacaggcgtgagccaccgtgcctggccggaatctaccactttttaaggaggaagaggtatttctggaaaccaccctgatatctgattaaatataacttggtaacagcaactgagcgccaaagaaatctgctcttcattttttttttttaacctgccatagtttgtttaaccctggttctaacttttgacaattcttactttattcaggcagcttgttcttgtgtagtataacttccagaactgtaaaagcctcgttaataataccttcttggtcatttaatttcagtgctttatttttcactgataaatttgatctagtttttagtgaaaaggttcttaacctagagtaaataaacttttgtggattcacggtgggctttatagtgtgtatgagaatttgaattttcctgaggatctgtaggttctatgactgttttcaagagtgaatgcaatcactctctcccttctcacttccttctcaaatagtaacctttctcctcagaaaatgtcaagtaaattaggatgatgttccacagtactaatgggatttaaatgtgcatttattctctgttggtatacattacaatatacgtgtttctagtaagaataaaatgtgattatggacttgctttaaataaaatgaatttgggataataaaacttaaattgctagtgaggaaaattaattttctcttgttcttatataaaacaataaagtcaatttttttagtaaaatatgccagaatatcccagtacaatcaaatagcttataataatgacatttcagtaggcacaaggaaaaaaaattgcagattatcttattttcattctagaattgttaaggacataaaatctgagaagcttgttagattattgagaggggaactgatagaaatgataatcttatatatttatagaaaatacttaaatttcacttggtattcctctgacttccagataaacactatgggaaagaaggccctgtgattctttttaagaataatactgtgcttctaaggctactttatatcaattatgttttctgatgaatcacaaaatgtgattgtacaaaaacaagcaaaaaggttttcaggtatttgagatttaagaagccatcattttgccacatgaagtacctggttcttaaaaaaaaaaaaaaaaaaaggtcataagaaatagaaagctgcaaccatggcagaaattcaaaatatactttgagaaaatacaccctccattttgtgctttctataaaatagatcatccattcatcatgaaagattgtgcacttcttatccagttgtagtgttattcctgttgcatcccaaatttatttccttcattcagagggtatttgtaaaaagaaatacatctttaaaagtccaaacattttaacttaaaaaattttgattttaaagaatcaacagtgcattgaagaagttcttataggtttggtgaccagttaaaacctaatccctggccaggcgtggtggctcacgtcagactttgggaggccaaggctggaggattgcttgagcccaggagttcaagaccagcctgggcaacatagcaataccgcatctctacaaataaaaaagtcagttgggcatagtggctcacgcgtgtgatcccatctactcgggaggctgaggtggaaaaattgtttgagtttgggccagtcaaagcttcagtgaattgtgattgtaccactgtactccatccagcctggacatcagagcaagaccctgtcttaagacaaaagccacaaaaaacacaaaacagacctaacctatttttaaaattttactgtagcattttctctacaccactaatataccacattgttattatatcatctatctgtatcactcactgaaccctcgactacttgagggtgaaaattcaatcctattaaatctgtattctcatatttagcacaaatcaatctgtattctcaacagctagaactcagtgagtactgtttaaatgaacaaattcacatttatcaaaacatgctcccctattttctttagctgtgccgtccagtatagcagctactggctgtatgtagctagtgagcacttaaaatgaaatgtgtctagtctgaattaagatttgatgtaaatatgaaatacacactagatttccaagattttgaatgtaaaatcacttatgtatatatatatattttaagataagagtctcgttctgtcacccaggatggtattcagttgcacaatcacagctcactgtagcctctgcctcctgggttctcatgactcagcttcctgagtagctgggattacaggtgcataccaccatgcctagctaattttgtatgtttagtagagatgagatttcgccatgttggccaagctgatcttgaactcctgatctcaagtaatccacctgcctcagccttccaaagtgctgggattacagatgtgagccactgtgcccaaccaatattttcatattaattccgtgttgaaataagaatattttttattaaatacaatataccattaaaattatatatttttttgctttttgaaatgtggctaccagatgatttaaagttatatatgtggtttgcatttgtggcttgcattaaatttccattcaatagtgctattcttaagcaaaagttggcaaatgatggtccctttggccatatctgtcttgtttttatatggccagtaagctaagaatgacttttacatttttaaaggattgtaaataaaaaatgcatgtgcaccagagaccgtatgtgacatgcgaagcctagaatatttgctgtctggtccttaatataaaaaagtttgcttacccttgttctaaagaagttatgagggtagaactcatggaccttagcctctagcatcttacactctagtgaaagtaacctcttagtaatgttacataatggaagtgaaattttattaagtgacagtattatgaatgtattcaggcattgtatgatatagaagtacactagaggggatcttgaaggatggaacaatttgagcagaaaagagtgataaaatagtgatgcactccccagatcccccttcaaagaactactaattgagctaggcatggtggctcacatctatagtgtcaccactttgggagaccgaggaaggcagatcacatgaacccaggagttccagtctagcctgggcaacatggtgaaaccccatctctacaaaaatttgctgggcatcatggcgcatgcctgtggtcccagctactctagaggctgaggtaaaaggatcacctgagcctagggaggacaaggctacagtgagccatatcaggccactgaactccatcctggacaacagagtgagatcctgtttcaaaaaaaaacaaaacaacaacaacaacataaaacctacgtacggtctcagctgctttgtaaagaggccccttgtccaaggtcataactttcccagggtggcccatattcagtgacgaatggcaggggaggtatgaaggtcccatcattttagctaacctgagacaactttgggattctgtattttagctccagagctccttaaggtgttggccaattttccttggaccagtgctttggcctagcttctctccctgttcaattctgcacccttttgcttctttactgaggttctgatcccaagggaattctctaatcaacattttgcataccacaccccatctcagagtctgctgttactgggagaatccaaccttcaatgggcaaaaagatgaatagcattccaattgttgagagttaagtaaacaaagagacagagggaaaaaataaaaaattcttttggaggtgaatgagattaatgacctgaatagcccacagtgtctacgtttgaaatgataagctataagattgcccaaaaggctttatcctggggacagcagaaagcttttggagcagggatgtgacatgaagaaaacagtgctttagaagaattaatctagtaaagacaaatgggattatagggaacagaaactgttaaagaaaaatatatccatttgtctgctaatttttttttatcagtgcctgatttcatgcatcatcagtaagtgatagttgaatacgttgtttaactaaaaccttattagttgaaatttgagaacttgaaattactctgatgatggactgtgatggatatttcctgaaggatggatcaggttcctttcccttagtctattcctgaagagggtaggaaggatacccttcaagggtgtcctaggctcatctaaagggtggcctggcattttgcccactccagttttccaaataccagcagacacagctgagcctattcttgccagttagctatgattgctttcttttccttttctgcagagaaaacagagttgcccacagccagcgtcaggagggaaagtgaactgtgtggtcaccctagagaggtagctgaagcagtttacctgggacctcctgtgtttgtttgtttcacagtcttacactactctggttttgaggaaagtgtttttttatttttgttgttttttctcaatttgaaggagttggttatttgatagtgctatttaaagctaaggaggagggccctttgttaacaaggttgggaagtgtggcacaagactaccttttagaatcatgcccacagagccagcaggagttgaaatagcctactttcttaccactgttactgccttgagaactgaacaagaaataaatattttgtcagtatatggtgatttttctcaacccgaaagaatttatccctccttggtctttattatgaattggtagaatatactttacttaaattttattgacaaaagtaaagatggacaatatacaattatgagcttattaaaaataacccataacccttcttgggggcagggaaatggttgcctctttaaagttagcaggttttctttggttcctttttgaaaagttgcctcaatcttgactggctttaatcagtaactctgaaataaattcaatttagttgcccgttggatattacatacttgcgtttccacagaaacaatttagtaaaatttgatattcaaaaagtaccagatggagatattatagacaagcaggaatgtaggatgcttaagtacatagtcatttgaaatgaaataaacaagtagtagaactatcttcttaacatgactcataattcctaaggaacatttgtattatcaaagtacctagtagttttctaaaagaatgactgtcttttgctcataaatttatttttaaaagttagtgccttggtttatcaaaatacaagttaagacatgtttatatcataatgaatgcagatacataggattgagtttatttcagtttgcattagaacaatttaatctcaacattcaaaatgtatgtactatgtatatactatattggagttcccacaatgtgttttgttttgttattttgatgtggggctgttttttattccccataaatctgatctgattatttttcttgatgatgggcagaaaatgtttatagattatgtaaatcactgattaggcatagagggtgactggaaagtggggcagagtggaagagagtagaaacgtggtagtgtcctctgtcttctagagcttctagttgatgttctgtgagagccgacctcttagtaaaccttagattatatgcttcagtatccacaacataatgttaaaggaatcaatagcacttaaatatgtcacttttttctgagaatacattgtctggaaaggtaaagccttggtagttcaggtatgtgggtggtatcatagatattaaacaaaagaaaaaactatcagataaacaaaaccaaagtagccatttttcatatggtttttactttaattccatggcctatgagagatataccatccccagatattttccagcaaacctcttctgtactctgttcaggttggctcctcagtcaatcccttttagctgcctttgccagtagataagcccagggatcacattatatgtgttctcagttgatggaataccactgagaaacatcatttcttctaggcaatttggcaatatctatccaatggaaatatagatataaccattgctccagaaggcatacttctagaatttattatccggacataatcccaaaaatgtagaaaaagtgaacatgaaattcccctcttctccacccctggcgtccttaatttcactctccaaagtgaaattgctatctgcatgtcttttcagacatgttttatgacaggtgatatagctatatacccattttttaatttatgtaaattggatcacactctgtaaactgttctgcaattagcttctttcatccaacatgtcatatacctatcacaaaatatgtttggaaagacagatggtaacacctttggagaatgggattaaaggagccaggggtggagaagaagggattttcttggttactttttcttttctctactgtttgagttgttttagcagtaaatatatttgtaaaatattttaaattaaaatacaaactactagaaaataaaagtgtgtaagataataataatgaggatagctaacattttattgagttcttacaatggaccagacactgctgtatacatatggcatgtgcttttcctcattaaattatcacagaaactgtacaaggtacatctattgagatccccattttacggatgatgaatttgaggcacagagagatctttggttacatgtccaagtcaatgtatgagaaaagagtcaaataagagcattgatatggaatatagatggtatccatgatggtttgacttaatgatttttcagctttattatggtgcaaaagtgatacacattgaatagaaactgtaatttgattaaccatacaaccattttatttttcatttttagtgtagtattcaataaattacatgagatattcagtactttattataaaataggcttcgtgctagatgatgtaggctaatgaaagtgttctgagcatgttttaaggtaggctaggttaagctgtgatgttcagttaagttagatgtattaaatgcattctcgacttagcaatatttttaacttctgatgggtttattgggatgtaactctataataagttgaggaacatctgtactgccatttataaatgatttctcctgtgtgatccagaagagtaaacattgtgactcgctagttttgtgagcagaaaggaagaaggtgggttcttttaaacaccatgacttctgcatttgttcttcggagtttaattcaaggagaaaatgggctatttcattaattccaaggactctatttgagggagtcattttcagaggaaaaaaatcatctatgctttggaattttttttaggtatcttaaaacaggtattatatgagtcatttctcataagaactggcttagtatagtaagaaagactccttctcatattttccaagattattggtgggttgagagatgtcagcaaatgatttcctctgttgcaatagttatccaagtacagaaagaagaaaatatatagtaggccaggcgtttgaaagtattttagaatagcatttcctttattcaacaaatatttattgtgtacctcagaaagttataattaatatatttttacattcaaattcaaactcctggctcttgaaaatctccataatctcttccctttttgtctgttaagctcttcctccacttttccaacaaactgcatctatttaggctggtttcttgatcattcttctgtaactatctatgtccttaagcacagggattatctgttggttcttagtgcctctggtgcctatagcatgggaggcttagaatggctagtgaatgaatgagtgaataaacacattcttttttgtctccatgctcttgcatatacatgtttccatatgtagattttgccttcccttctttcttcaaaaccttgagaccagagttagtgtgcctatagtgagaccctcttccagtacgactgacctcctggctcagatgcaacaggtctctactgtttcctgtaccaaatcaagactccttggacattgagggacattgtgcttctttgtatatccaagtgttagttcttattatgctgcttttcatactacctcaaaacgttcatatgcattaccttctctgtactcctaatgggaccatctttccattagatgcaggggatatgaacatgacctctggagagatgacctgagttagaattctgactcttctacttcctagctttgtgaaggtttcttaaaatttctacagttcagttccctcctctgggaaagaatgaaagagaagcctgccttttggaattatgtgaggattgagtaatctattaaagtgcttagaacagtacctggcatattgtaagcattcaaatgttagccattattactgtgcggcttctgtgtatattttatctcatccgtgatgaagatgagaaggcaagggctgctcctggcccctacaaatacacttacctaatagctattatcaatagatattagaaggtgggtaataacaacccttgagaagaccagggagatgactgaagattgattttgggtgattttttatgtagagactttaattcatctctcttgcttcttaatggatccaccaacttaataaaaaataattattgattgttatatgtgttagacaccattctaggtcctggtgatataccagggatcaaaacagaagaaaatgcctacctccatggagcttacatttcagtcctaagtaaactagaagtatgtgagatggtaatagggctgtggagaagaatgatgcaagggaagggggctaaggagtatatgtgtatgtgtgtgtgtgtgtgtgtgtgtgtgtgtgtgtgtgtctgtgtgtctgtgtgtctgtctgtcaagtggtgtgcgttgcaattttaaatatgatggcttagcaaagacctcccttagtatggtgcatttgagacaagttttgaatgaggtaaaggaatagccatgtggatatctgtggcaagagcttcctaagagttgtcaggaggtgcaaaggtcctgagttagtagcatacgtaatatgctcaaagagaagcaaggagaccagtgtgtttggagcagtgagtcagaggagagtaatagaagataaggtaaggggcaggggcacagctcatacatagcattgcagatcatagcaagagctgtatcatttacactgtgagcgatggggaccatttggaaggttttgtgtgcagggataatgttatctgtcttaggaggcaatggggtcaatctggttacttggttgaaatttggttgaaagtaaactgcaagaaaggaagggagataaattaggaggctattgaagtgatccaggtaagacagtgctggcttggacccaggtggttgtaggggaggtggtgagaagtagttgtattctggttatattttgaaagcagaccccataggagctgctgacaaattgaaaatggggtgtgagggaatgaattgcctcaaagataaggtttatggcctgagcaatttagcaggctggaattgtcatttactgagatggggaaaactgcaggaacaataggtttggtgggaaggaacaagagctaagtttggtcatgttaaatttgatatgccttttagacattcaaatggagatagagagttgacccttggatatggtccagaattcaggggaggagtagagaggtcaaatttggagataaaaattcaggcttgtcaatatacagtatttgaatcactgagactgaataggaaattatttcaaaatttcttctgtcattccttttccccccttagtttatttttctttattttacttactcttcttacctatcttcccatcccacaaattccaaggcagaagttagtattgacagttatcatccagcttgggagatgtggaggaacattgtacttttcttttctcacttcgtgatgtaatcagagtaagtgcttattgtagtgaggtgacagcatcttcttggtgactattaggttgtgatcaaatcatgttctaaatagaaagtgcgaaacttattttcatgttccttttattagcagtatttatttttccatcaaccatatgctaataattcatgaatcaatctataaacacttaaagaacactgtgtacctgtactgagaatgaaataagagaaatattactaaaagtttctggcctcaaaaaatttgctaattagtagaaagcctggtctcacgtagtaaaccaattagagcacaatgtatgatagcactgaattgtgccttgggttgtatggtgtggcttataaggaaaagcttattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggcagcttcattgcaagagctgaaagcattaatgagtttgtgttaatgcttcattaataaatcatcagtggctaagaaactagatcttccttttcctgaagtctttaatgtatcttgatgctccattaatctgggggtcagggaaactcctaaagtttgaggtcagatgatatcatatggtatttccattctctgagcaaattggctgtttcttacacccctgtattaatccgcctacccctagataaactggttagctgatatggataatgaatgcgtctttaattttcatgtgaggtttttaagactaacaaacatgagaagattgtatatagaggaggagtgttttggtttttgcttggtaatgctactctagcatgaataagtgagtagatatattaaaattcatttttatttagctttggaatgcttatagaatggtttgtggcagatatgtcttcctatttgggttcattttgatagacatgaaaattagaaaatattatttagatagtgtaaaaaagtaaaaaaaaattacctttcagtaatctccaaacaattttaatctagacaaatgaaagcatttttattgatagtaaaatattgttttatttttatacttgtgtttggtgatagccatatctgtcctcagatttcacagcagatcttttaagttattaggtcctgagcgaaaatttccaataaatccctactaacctttcaaaaaacaaacatttccatcccaggtggaatgcagggaatatgagaaacaattagacacaaagagaagggaaacagggcattagttctttctcctctgacacttgctgcctttacttgatgtttcctttttctctgtgaggatcagagtttgaggagtatttgggtcttggcaagtgagtagctaatctttagcaaggtcttaactgaagctaccaataaaacgcaatattttaaatgctttacactaataaagtctaaaaaaaaaatctgttagcattttggaatttagcagaactagctaaggccctctttggctttcttgacttccaggctggtctcctaggaattttttatgggagctttggggctcataaactgtacaaatgttggttctgacaacgtaatgaaaccacacaggccaggactgctgcttgaggagattattttaggactggctttcttatgaccccttactcagaatacttcttgccttccattctatggacagtatccctcagaaaggttggcttagtaccagtttctagtacctgctgtagacttgttttatttattttttacatctcctgtaggtcagagggaacataatgacttcctgtgggtttttgcctgaatacggaagtaaaagtaagaactttcatgaactctgtgtctttatgaaaaccattataagcagttctgcaaattatattaatagaacttgaaaagatttgttttaagtgatagtctatgaagataatagttctaagaataatgtaaaatgtatatacttgtatccagggaatatatcaagatagatagataggtagatagatacacacacacacagatatatacactgaatatgtatgtatgtatatatgaatatgtatgtatgaatatatgtatgtatatatgaatatgtatgaatatatgtatgtatgtatgagtatgtatgtatgaatatatgtatgtatatatgaatatgtatgaatgaatatatgaatgtgtgactatatgtatgtatgaatatatgaatatgtgtgaatatatgtatgtatgactatatgaatagtgtgaatatatgtatgtatgatatatgaatatgtatgcatgaatatatgtatgtatgaatatatgaatatgtatgtatgaatatatgtatagatatattccctattcccaaatattttgtgcatgtatgttttgtatgaatatttagggcaacaggaattacagtagtaccatgtaaatgtaaataatcacaatttaatattactcaaaattttcacaaacttagaaaattatggccatattttaatgtagtgaacgatatcaaattgatgttacttattttaaatatattttatcaggaggtctgaggataactgtttgcattctccttaggtagggatgaattggtgttttgatttgggaatggaagaaatatggtcagttgagaactcttctgcagacacaaggcacctggaatttatgaaagaaccttgagtgctagagataatcttctcttagagaacaagaggttgaagattgaggcacttagcaagaactcttaaattattcagtggtttcctcagcagcattttaattcttgctcgtaactgtttcatggttgactttcttcttctcatgtattgctatttttctttgtccttttctcaggaataggaagaaaatttcattaaagcacaacacagaattatattcattggccacacttcacagaagattcattgcataatttggccagtttccctcaccacccatttaaatagtgtggcaaatgtatttggtgggatttcctcaaccattcagaaacatttactcattttatttttatttttatttttattttttgagatggagtctctctgtcgcccagggtgcagtgcagtggtgtgatctcagctcactgcaacttctgcctcccaggttcaagtgatttttttgcctcagcctcccgagtagctgagattacaggcattcgacacaatgtctggctaatttttgtacttttcatagagacggtgttttaccatgttggccaggctggtctcgaacccctgacctcaagtgatccgcccaccttggcctcccaaagtgctgggattacaggtgtgagccactgtgcccctgacccatttgctccttttagatttagatatatcagtagaatgattgtagctcaggaaaatctactcagccagatagcattacctttattccttccattagcatgtgcacttctttccagctagttgtccaattcaggaggcacagatagctgtaatctaaagtatataccttcatgttctgaactattggtagagcaagtatggtaactaaatctaacactccatgcaaactaggtagagttttcagtcttgtagattttcagccaaagtgttgtaatgggtgacgtatgtctttttaatattaatggagggtgttctaccctttagtatcttttttgtgacagtgatggtggtgaattgctgtcatggattctggttgttatagatccagagtgttctattaaggaatattctgtgttgtaaatcccaagacaattgtgaatcttaattactctgcttgtaattacttctttagtgcaataaattaatcttagtttatgtctaagcattttgggtctcagggcattcataaacaatctctcatatttcctgtgtgatctgttactgttatcaagagaagtgttcagaaagagaagacaactggccccaaactatgtggaaactaataaatacagaacagccatttttgaattttagtctcacagtagcttataaatctctcaaattgcacagtgcataatgaaatcaatgaatatgtgaatacattaattcaaattaaaacttgcccaggactgatctggaaattgttcaacattagtaagaaagcatgagatatttttaaatgggagagaagtctaatcatcatacgtggcaaaaagataaggaagttgggaaatgtgcaataatatagacatcatttagtagatattttgaaaatacaactttggctcttaataataataaaatgtataattaaatactgttgcctcagtttatccaagatgatacttgtttggaggcataagactaaagatcagtgtaggaacacatctgctcagggggacctttgtgcccacaactgggagctcattttttttaatttaaattacctccttaaacatcctgggacctccttccatagattttttttcttggctaatataggaattcagatgagatgtattattggtccgagtagtagaagttatggacctgtgaccttgtgttctcccatcacaattttaccaacatcttcagtagtatgaattcaggaatggaggtagggttgcattggaggtgaattataaatcatgttaaattgttcaagaattttcttttgttttccttggtcatcaaattttgaggtttgctaagttttgttcttttctttgtttgagctactttttgttccttttatcctgcctgatctggcttcattttgtcatttttcatggaggttctcttatgtcacctattcgcccaccatggtattggtggtattcaaacttaatgttaattctttcatagtagcttggttatatgttcaaaaaatatttattgagtgttcattatgtgtttggcacttttctagactttgaagaaacagtggtaaacaagacaacgtgttccctgccttcaagaagttagtgttctagtgggaatggaaaactggtagggcatgagaacagatttcttttatacaagttgtcaaacttgtgataaaatgtgataatttcagattgtagtaagtgctatgaaggaaataacaaaagtgatgtgattccaatcaataaaatgatagtggggctgcttgagaaagaacagtaagggaagatgaattggtaacatttgagcaagctacccgtggaaaaagcaaggggagaatatttaagccagagaaaaaaggaagtgcaaactttctgaaagaataagaaggacaggatggaggcaaagaaagggcactaatgtatctggagtatcatgaacaaaagggaaagtagaataaaataaggttggagagacagggagtagctagtttaataggaacttacagaccttgaatcttaggttgggttctgcatgaaacagattctggagtggagatttgcaggaacaaatgtaactggagagttctcttgttctcagcatcaaacagctttgttcatgctggaggaagtcagctttctgagagattgacaagagtaggaaattaattggaaaataatcttcttttttgttctaatttatccttttaaccatttttttttgagatggagtctcgctctgttgccaggctggagtgcagtggcacaatctcagctcactgcagcctccgcctcctgggttcaagcaattcccctgcctcagcctcccaagtagctgggactacaggtgcctgccaccatgcccggctagttttttgtatttttttagtagagatggggtttcaccatgttggccaggatggtctcgatctcttgacctcgtgatctgcccgccttggcctcccaaagtgctggggttacaggcatgagccactgcacccggccatcatttttttttttagtgtgctctttcctttttttttttttttttttttttgcatcttctttgtatattaatctgtttttgctcttttttcttcaatggtcattttggggtataggattgattttgagacagactgaaaacagttaaaaatctctcttagcttttcagacaagaagcaataatgaggtggcctcgtttagtggaaactggaaagcaaagatgtgatggacttcagagatatatagggtccggaagttggcaattctgtgactgaatgcagggatgaaggaaaccaaggagttaaaggtgaggaaatcagttggggcaataggaactagaagaggatgagttctgttctgtggagggtccttctgaggtgcctcataggacagccatctggagatggacctctggcagctggaagtgtttagaaatcagaacagagtgcaggctagagacacaaattttagaaacgtgtatgaaggtaataattttgtaaatagatgaaggttactatgccatttttaatgtcaagtacatataacagagagcatgtcatttaactgaaaaatgatgaaaagctattttattttcacatatttaaagattgggcatagttagaaaggtgaatgcaccttccctcccactaaagcttctaagaccttttgaatgaggttagtaccagatgaaattctgggaacacacagacctccttgtgagggacacacgtttggcagatacataatcttaaggagagatccattagtttgcttcatgctgcttttggatggcaagaattttgtactgttttgcaacagatatagttttgatagattacattggagggcagaattttctggaaggccttttcagatttaggaaccatggaaaatcagtcattatttagtaatcaagagaattaaatgcttttattttgctgagcctgatctacctagtgaatgttttatttctctccgtgtgtgtatttcattttgcaaatataagtattattctgtgtactgctttattagttataattcatgtatcattttgtaacagagaagtatcttaaaattataatgtttgcacaagattctctgtgatgattgaaccaagaagggatgtaggaaacaggtagggtgcctgatgatttaatatttcatcttaaagacaaaggagaataaaaacagtccatttgtatttggctgcttttatgttactggcaagaacagtcagaagctccccattttcaactggtggttgggtgtccaaggaattcttgagtttgttatttcatatgaaggatgtgccagataaaaacccttagagaccgaaagtttccttgtttagtcacaagacaaacttgctcttttcttgtagcaaactatattactaccctttgtctgacttgttgatttcgagttggagggcagtgtccattggtccatgtcagtcactagtgcacctaataaaaggcctaacagatatttaggttgtcagtgtttgcatgctagttggttaagccatctgaattggatttgattgatgacctcgcttgcccttaagaagagggtttgtgaccacaagccacagaaaatgacatgtaagatcaattgatggttagtaagttaaaaaacatcccatcacccattttgtgtgaatattgtattgctatgggttttacttgggaacatataaaaaggttaccacatactccaatatgtgtttttcctacatttcagtaacacctgaatggaaatctaacatgaggactgttgaaattatttttttcaaatggggaagggagaagaaggttaataattttccatactcagattagaaaggtcacgaccatatcagttcaaagaagagaatgcatgtgctcatggctggttaccaggtgaattttgcaaacattttattatatacatagttgattttttttccttcctgggaaacttatatccatgaatctggagttttacattttggagctacattttttggtcccttctacctatattatttttaaaagatatctttattttaaaattgagcaacttgaagtgtatgtgtgtgtgtgtgtgtgtgtgtgtgtgtatacacatacctgtattgtaaataagaaaggtgcttaataagtttgtcttaaaactcatgaaagcttggcgtaaaatctcacactaatcactatggatgagaatggctctcgttgagaaataagggctgatggcttttttctcaatgatcatgttaaaaatatattgagagcattgtaggactccagatgcttgggttgtggctcacaatttttacagaattaatttccaaaattcttgattactccaggaggaaatttattccaaaagtaagctgtgtgcttccttcttaaatttaaaaattaatgcatcaaaggtgtaataaaaatcatctcttacaattagaggtcctaaagaaatgtttgaattattatggcaattagaagggtaccttacttaagattttgagagttttgttgctagcaaagcagagaaataaaaagttaattacttttgtaagggaaaacttgggaatataggtatgtccctgtaccttttcagatatgtaaacaatatttaggtatttttacagagaattgagaaaaagtacaggcactgacactactacaaccatagtagaagacactactacaaagatagtaaaggacaactttctatgtagataaatatcagttatttggagtttattatctgaaaatattttgataatttcttcccatttctttcaagataaaaattaagttttaatagcagatatcttgcttagaatcaagtacattttagtgacttggcatttattcattattcgtttatttagtttatcacttttttttttttttgagacagaatctctttctgttgcccaggctggagtgcaaggcatgatcacggctcactgcaatctccgcctcccaggttcaagcaattttcatgcctcagcctcccgagtagctgggattacaggcatgcgccaccacatccagataattttgtatttttagtagagacgggggtttcaccatgttggtcaagctggtcttgaactcctgacctcaagtgatccacctacctcagcctcccaaagtgccaggattacaggcatgagccaccgtgcctggcccttgcttgtagactttcattctctggttccatactccacaatattatcagccctatctctcaaaaatagcattggttatattatagcatcaattaattacattgacataaaattaaaatgtctctacttgtcacttcttgtaatattacctaattttgtttttctctaatttttcataatttatacacctaatttattacctttcacgggctcatgtgtttcctatttaaagtctgaaatgtggccaggtgcagtggctcatgcctgtaatcccaacactttgggaggctgagttgggaggatcacttgaagccaggagttcaagaccatcctgggcaacatggtgaaaccccatctctaccaaaaaatatgaaaattaccaagtgttgtggcgcacgcctatagttccagctacttgggaggctgaggtgggaggattgcttgagccctgggaggcagaggctgcagtgagcagagatcgcgccactccactccagcctgggtgacagagtaagaccttgtctaaaaaaaaaaaaaaaaaagaagtctgaaatgtaagtcatttgtatctgttcaaatgatataaggtggtatcaagcattcttacacatgatggtggtcttagaaaatcatttagaggatgctaggagaaaaattgagctgccatctggagaggctgctggattggcgactccctcctatcattggtttactctctccaggtgccttactaaagagaatcaacaaagagagaaggactttgctcagtaccttctgccttagaggcctgtctggtcatctgctgccagctctttccagggagagatgaggagcagcaggcctgtgctctcaagccctcagggaatgcactgcctccagtgggacagagtggagctgttgcttgtgtcattgctgcagcacattatttgaaactgacctcaagacttggatttgctcagtttatttttagaagtaatgacagtatagcactttgaggcctgaatgttatttctagacaagagtaatactgtttttctgagaagtagaatttcaggatttcaaatggattttttggtaaatatttctgaagcttttccagtaactgagactttctgggcagaaaggcaagatgggacatagtgtgcatcctctgttcttgctgacctcagtatctcagagtgtgactagacgctgttaccgagcagctgcatagtcatcttcttcccttgttctgagcaagtcctctgttacacaaagaagaaaaaagcaatcattcttttcagtcatttaccttccaacttactaaatttgaaattataattatacatacagtacatacaaggttgtctgtagggagtatatttgtttttatgtcttatattctggcatgtatatgagtttgcctaagagatttggagatacatacacatgcatacatacatgtgtctgactttttatgtaaatatattttgtatgacgtgttaatttatatgatacatggctatccaatgtggttatctctacaaagaaatgtactcacagatgcatttaatttttacagatacaattttcattagctttctaactgaagtccctgcctgtagactttcattctctggttccattgtgtactccacagtgtcatcaaccctgattttcaaaaacagcattcatagccagcagttttgtcttgcttcctatatgccaggcactgttctaactttttatatataaatctctcaacaattccatgaggtaggtgctgttaacatcctcattttacaaaagaagaaactgaggtacagagaggtcaaaaagctcactctaggtcagaaacaatcctaagtggtaaagtcagtctgaacccaggcagtctaactctaaaatctatactcttaactactatattgtgttgcacacagaatctggttcctcgtgcctctgatcaaaaccgatatttcctgcagcagaaaatcttaacatattagcacaggattaatttgttagctttttatgtttttccctgctcacatttgaggttgttatccacagacaagtatatcaaactattgctgttctccaaaccttccagatagttttctgactctgtgatgttaatcatgctattccttttatctgaaatttacttcatctttttctacccagaaaacgcctatttattcttcaaagcccatatcagccttcacaactcttttatgcattgttgtaaaattgtattttctctcatctgtgtttccgtagcacttaataagtaactccggttttggtgcttctttcattgtatggtggtgtttatttgcccttaagtgtcatgtgctcttcattgggagtaccatctcccctctgctgatttcattcaactgtctagtaaccagattcacctctcagccatgttcctgtatcatcagtgctgctctgcggtgccctgtctggttttcagtcacagtttcctgtgcaggtggtggaggattttgaaatgcttgaaactgaaccattacacccacttgagatagtttcttttgtctgtgtatgataggaggtgggtggggaaaaataagtgcacacagcctattacctggagttgagatcaccaattaaatgtcatgaatagggtaagataacacatattagttgtgtttaaaatattttgctccttagatttttattcactcttcactttaatttagaaaggcagttttcagatgttggatgagcattgactaatttccaaatacctttttatttgttttctgcattatagatcatgtgactcaaatgtatttagggtagctagcagatgattgaacatgatgaaactatgagtcttttatttatctaagtaaagcagtgaatgcagatgggtttattatagtcatagggccccatgtactttagtccttatttcatccagcaaaacttcgatgactaattttgacttcaattgaggaatattttatttaaaacatttgcttagaataatagtcattgtaaaggaacacttttcatgtgtttactgaaccaaatgctaagatgatacaattcctaattttaaataagataaatatcaaattataggtttttgcataattttagtaaaatagatgtgagaaagattggagattatgtgaggattctaggtacttaagttggagtagaggagaaagaaggaagaaatggcctactcataattgcattacagtttttttcagtcttgaacagaagttgaagtctgaatggtactgaagtaaatgagagattcaaatccaaaagaagaaaaagtcctcattataaattttggaaatgcataaaaatggtgaatgataatattctgatatttgaaaaaataaataaagctacattttaaaatttaatttataaaagtctgagtgactttttaataaattaaaatttgaaattataaatttatatgagaaattaatttttctcatataaaaatacatttttataaatttctcatatactttcctcttaaagcagtttatatgtggcaattttttaaaaaatgaataaattaaaactgaagattgctcttcctcttctatcaaaacagctaaaacatttagctcctattctgtgatgcaaagtttaacatatgtaatctgatttaattcttgcagttacctgtacagcattatcatcttccatcatatatgcatggaaaattaagcttagcaatttccccagaaaggaaggggtagaataggatttaaactcaggtccactgctcctgtatcccatgctttttctagtatattttggtagagaatgtcagttttgagtacagacatactttgtgctggagaaaccagcaaactggaattacaaactaatcaaatgacaaaatggaactggaaaaggctgttttttttttttaattgaatatgttactggcatatgtaaaacagaagtcatttaaataagatattcatatttcagttgtcgtttaaatatcagtagagagtttgattaaatagtggattgtctgggtgtctttatccatgatctttgcccctgcagttatgatcacttatttttatagcatggaattaactcagcataaaatttgaggtgagattttgttactcaaaataatcttgaagttttctgggattagtgaatgttttcttgggactggccatgtcactcactatctttgcactgaaaatgaagaatatacagtatattagtccattttcatggtgctattaagaactgcccaagactgggcaattcataaagaggtttaattgactcacagttccacattgctggggaagcctcaggaaacttacaatcatggtggaaggggaagcaaacacatccttcttcacatggcggcaggagagagaagtgctgagcaaagggggaaaagccctttataaaaccatcagatcttgtgagatctcactcactatcatgacatcatgggggtaaccacccccatgattcagttacctcccaccaggtccttcccctgacatgtgggaattatgggaactacaattcaagatgagatttgagtggggacacagccaaaccatatcacacagtgtatctcattttttactttttatacagaagtattgcacataatatgaagaataaagggaaagaaatatagcttaaatatgactatcagtaaaatacaatatttgcttcagtaaatgtagtcaacagggagctaagaaatacctgggtcttccagcacttcataatttaatgaatgattataggaaaattacagaaatccttttgtacttcattctttctgactcctaatttaggggaatggtctttgagacccacctttctcacagggagatggtgaagattaattagcccatgctagccaagttcccagtgctgccccagagaaaggtgttccataaatcagacctatcattaaaatgccttcatttgtgtctagtccttgcacaggatggtgccatcactccgtatcctaatgggagtcacccacattcaggccaaggacaggtttttccataacacaaagaacgtttgttctatgtgactaggcagatttcctcctctgtgtgcctcagtgtcctcatctatcaaagcagcagtccatagccagataattcctaagaggaacttaccctagagttgctctgatttatatctttttgtttgtttgtcccactcagcttcttgaacctattaaacttttttttaagctcatgtcctacgaaagaactgtaacagacatagagataggccattcagatgcccctccaaggaaggcagtcaggagagcctccagcagtcagggtcagcttcagctgcacagagctggccctcccaaagtcatctccctcttgtggcacctcacatctgatgactaagttaagaccccagcactagacaactctgatggacagcgtttgttctagagtgctccactggtttgagacattggatttgcctcatggttgtttctcatgcttcctgatctttcttccttctcctttccagatctgataaaatcttacaggtcttctatgtaaatatcttacgccctataagccatctcagcatctgcttccatagaatctgaacaatgacaagaacttaaataatgtgaaaaaatttgtgactggcttgggcaatgtagcaagatcctgtcttgattttaaaaaaagaaaaaaataataataatgtgaaaaaggactagtagaagggaaatcctcaagccacaaattactagacttctttataatgggcttgtttcatatactgtagtttattaatttggaaattgtattttcatattaaaacaaagcatgccccagaagaaaggttcagtcactttaggtaacttttctttagctgtcttcaaataaatcattgtgagaggcctttcttcctttccttttttcttattctttcttaaatagtttagatttgcttatctttgtcttaagaaaactagtaagtctgacacctactatgaagttgatctgataaagtaagttgtatgctgcgtatttccaaattagatttcctattgtaatggagggctagtatttctttatttgttctttaattcacagtttacatttagaagttttgcttaaaattattttatgttctgaaatcagagtcgtcaaaactcaattcagcgtttttaaaaatttgctttttctctacccatggttaagggatatgacttactatttctgtgggtttcttttacatgttattattgatttttaaaatcaggacagaaaaagcagagactggagaatatgtggctggaatatatgatggacatctagggaagaattaagaaagaaaagaaaatggctggggagaggcaagtatttaaaaaacaaccgcatgtgttagtagagaagaggataagagtctaaattttgacatacgtgtattagtaaacctaagctacttttgactttgcacactgtttatttatgttgtggtcacagagttaattatatctgttagaacaagcctttgaaagtttaatgagctctttagcattaacaacctttcatatttccttatttttttttcacctttccattcatccatcttaaattttgcagctcttaacaatgttattgcactagaaccccagagcagcattaggtgagtggaatgtgttccagggttaaaataaaaacaaggcacagtacatagtgtgttattcctattacataaagtattatataaaaacaagctaaatttctgctattagaaatcagaatagtggttattctggtgtggaggtaggggcagggagtaggagaggcttctgggtgctggttatggcacccagatctgtttcttgatctgtgtgctgatcacatgtgtgttcattttatgaaagatcattgtgcaatatactcatgacatctgcagttttctgtctttgtattttatacttaaatattcaaaaaattgggtgaaggaaatgcctgtgggctggatttactttgcttcacttagacctttaagaatcacagaaccacagctagttagatttaagttctagtcttctacaacactgtagggtttagagtaactatagttaataatttattatatattttcaaatagctacaagagaggattttgtatgttcccgacataaacagatgacaaatgattgaggtgatggatatgctaattaccctaatttgatcattatacattgtatgcaggtatcaaatatcacttgataccccaattattataatatgtgtcaactaaaatttaaaaactaaaaaaaaaaaaatcacagaaccaactataaaatcacagaaatggaaaaggtcttagtttagcccactgatgtcacgaagagaatagatgcctaaaaggctttgaagtcttgcaaggatcctagggaacgatgatttcatgtcttacagctgaggaaactaatgtcagtaaggttaggtccattgcccagggtctcaccagagcctgctaaagagctctcagatccacctttctctgctgttcagcttctttctactgtgtggcttagcctgtctcctaatagcagcttcttcatagaactattcttattaaaaacggggcttgagttaacctagcttatgaggatttctaatgacaactcttacaaaaagggtatttttcatttaacttgtaggcagcctgattttcagctgaccagaacaatcaaattataaaatattctagttatttgagatgttaccatagatagctttaaaaaatctttattttcatgacatttattttatcacatagctattattgcatagtttcgcttgatctctgaagctttatcaagatgctactagatactatcctatgcatattttccacttaacacaagtatgatatcccctttagatttatatgtattctgctaccatgaaaagccatttttttcctctgtatacatgagattatttttacttgactgacttatctctttaattcattgcctgtcattcagctcatatcatatatatcacatatatgagattgataacctaataaataatcccatttttgtcaatccagtaatcattgaatttactagaatctactcagttcttatccaagggccactactgacatgggccttcttatttagatggtattgcatcgcttgactcttagagaaggctctggatgattgacagattatcctcatgtctgacggaagtaagacgagcaagttccttcaagaaggaagtaagccaagttgtatcagatatagtctccattctgttactttcactttcctgttgataccccttcttcctgtttattctgaatgcatttaataaatatttacgagtatttgctgtagatcatacactgtcttaggagctggtataaaatggtgaaacaaaaaaaatcaacatagatcctgctgtcttgggccttattttgttagagacagagcattaaaaaaaatctttcagctaaatagaaatcacaaatgggtcaagtataatatagaggtggaatttgtgctatgtatgtgagccaatggtagggagtctgagcacattaggaatggcttccttgaagaaaagatacttgctttaggatataaagaatgaatagacagacataaatcagacagaggagcgattagtattccagcagccaggatagcatgcacaaaggttctaaaggcaacccaatagtgtaggggagtgaggctgaattttagctcttcgcctttagggttttttctggctaggcctaagaattaaattgacataggacagattaacaggagaaaagcacaggaattgatttaatacaacttttacaaagcagtgggagtcctcatgaagaaatgaagacccagagaaacaattagagtgaatcagttatagattgaattggacaaagaatagtaagttgtgaaaaagcaactaaattatgtggagaggcttaagagacaagagctattttagcaaggtctgtacagaattttctttggctcaaatttccatccttgatgataagaatgttgctttccttctggtatagggagaggacctttcagtgttcctgcttttaagaaacagaaaggaggccagaatgatcttgtacctgctgtttttcaagtacctttaattcacaatagtcattatgccagaatggtatatttttaactccttcaatggcacatttgaggaactcaaagaaggccagcatgacagggtcaaagagtgcatagagttgtgtggagcaaagtaaataaagtgacttatggattgggaacagtggaggagtcagtggactggtattcctgatggtttgaaaaaaaagccactctaggagacactgaataatctagaaaatgggcagtttatggccagcaactgtgatttttaactccctgattctggaggaggatggccaagtttcaaggaatgactgcgagagtggtgactgaaatcgagtggaaatgaagaccactggagacagggaggtcaaggaactgacaggctgagtgttgaaccagttatccttgtgtctgttgaaatagcccagaatgttggcaaactttcagtgaagtagaagactggatagatgccaagtctttaatacataaagtgggttgaatggtggtggggaaagagaaccacttagtgtgcccagtaaacatttcataagatttgaatggtttgtatgatagagataaagtttctagattttcaatgttatattttcccaattgttcattatattttggccattatacagatatatgaaaatctgaactaaaggagtttcctcatctggcttgcatatttcaagatgataggaattgtgtcataatcactggtatagaagctgtacagatcttggcttacccaaagacaagtggtagctgtgaatgaataaagcatagggataaattatgaatgaagaaaatagtgcatcagctctattagatggaaggtgttattatttttaattttatgcacatgtgcaaattttatgaactttacatggaattttacctctctgactacaattacctttgcatctacattaattacatagtagtcgcatgttttttttttctttcagagatgaactttttaatcagaatacttacttttcctctgattccatgggaactttaccatttatactaactttttgtggaaccaatgagttagatccttttgacagaaattgcacggaggggcattctctgatatggggatacatcttgtctggaaaggatcttcccctgtctgcacctccattcatgtttgtaaacttttatcattctccatttgtttatctggctagtgagcaatctctctgtaccaataattgcctaagggatttaaccagcttatgaaagtatgtaagttatgatttttaaagatgaaagcaatatgttatatatatgcctaggaaaagactggcaagacattcatcaaaatgtaaatagtggtatatctaggtagtggggtagttttatatcatatttatttctttaagctgaaatatacatgtttttcagtgagaatctatcatgttttacaatgagatttttaaagccaatattaaggtgaaaggaaaaggtaaaacaagggtaggggaaaagtcaggaattaggctatgtgaaaagaagagtttctttttctattgtgtagaagataggtaagttgtcaaagatggaatatgcacgcatggatgttagcagtatgtttaattctactgcaagaagctaatgcatgatgctctcttcagaggcttctggtcacagtcccttatttccaggtcacttggcagaattcctagagtctcaagttttaaggagcaaatagtagaagttcctccttagtgcctctgttgtttattctctcggggggagtagtcattgatttctgttaactgtgatacaaaaaacccactaagcacctggggcttcccttgccaccccctttccatttgttaggaagccttctttaagctctgagaatatctgtggattaacacaagtcagaaattgttttcagtatcactctgcagacagacatttagcaggtgggcagtagatctgttaatttcccatgggagaggaaattaactgtccagcctggacaggtttttgtctgccagctttgaagtttgtcacatagaggaatcttcctctttcagaatttagaaggaaccacagacaatttaagtggcattgaatatgcttccttgtaaactgtgggcatcaagccaggcagagttgcaataagctcttaactttaggcctgacccacttgtaatgctatgacaatgccaaatgtgtgttctaaatgatgcagtacttacctgagacagagcattctgggtaaaaggtaaatgttccttctcaatgaatgatgaacgatgacatctagaatgatgattaattgagaataccactctgctcagtctggggaattttattctgcatttcatatgtatcataaattcaatatcagaatcaataagatgatacactcctgaagtgtaggttatctagaaaaattttaggtgattttaaaaaaatatgcaagcatatttaacaactgctttagtataatctacctagattgttcttcctagctctgcttccaaagggtattggacatggaattgtgaaagcagaggtatgtgatgtaaaggcaatgatattcagtaaattcaaacactagatggttatatatttgttaaatatttataataaatctgtaatcagaattctaaccatctagcttcagtgggatgcaagtgggaacaactttattcctcttcccactgaatatatttatttcagccatgtaagaagtcttggttagatctcagagctttgctgtgtcttttagtcacaagaacagtctcatttcaggattttaaaagtcctgatcagagtaatcatttaaaatttcttacctcaggttgggcctgtttcaggcttgacagcctccttgcaccagggggtgtatggtactgacactctttgtcacctgacttcctctcccactcactggctgcccttagggccttttagagaagagctgtaagggactgggcaagtctgagtcactggtgcagttccaacctgcactgctaccctctgttagatgcatgattgctgactctctcttcggataaatcctcttagggacctctgggtatagttcctctgatagtcatgccgcccctggctggatgtttttagctgtctttgcagctcctgggtttctggctttacaccccacttttgggattacattgccttgccaggtggtccttttgggcattgtcccttgtgagatcattcctcctgtgggcctgtatcctgtccatgagaattttcttgcaattgttggaagcatagcctgatcacaatggagtcctctaggctttgcaattccaggacagttagcaagccacaatttcctgcctttaaagtcagatttaaaataggtagtagttatttttctctaactccaggagatgcatttttttcaaatatttctctcagagacactcattcccttccaatttggtacccttgagtaagctcttttgtggtgtgaagtaggaggtggtacagaatgttctaaccactctatcctgagtagtcctctctgggggtctcattaccttctcttgtagagccaaaagcaaacagtgggctcatgatgacagaatggcttcaaatgaacccttggcaagttctggtttggcacctgtatctgataattattttgtttttagccttcaaggtttcagctaaaacggaaaatttcatttgttttatattttttaattgatatgtcatagttttacatatttttgaggtacatgggatacacaatttcattttaaacatcttgactcagtagtattttttttcatttaggtggctgcattaaacctcatttatgtgtgtgtttgtgtgtgtgtatgtataggaaatgaaagcattcacaaatgtggtaaacaaagaatatagaattaaattaattttatttttaattaattaattaaattaattcaattaatagaattaaaatatatagatgcaagattttaagtgtcttacattttttaacttggggattgtagttcaatcaatgataacttcattttcttttttcaattcaaaggatattcttataattgctagtttaattattagtttgcaagtacttaaaccgaaacatcttacttcatcttccaaaacagctagcagttcccttgtgtttgcttaataaaatattaattacaaatatgttaagtagcatgtctgatataaggactttttcccttaaaaataaatacatagtatctcaaacttacagtatcttaataggatagagaggaataaatatacctttacacatgtataagatttgcttttttgtcattcttggcagagtctgtactggaagccaatttctttaccttgactttcaacttagtgatcattttactatggcgggtcactcatgactaatgtaatataagatatgtatgggattttaatgactagttttagcagtataaatgagattctattcacttaaagaagaaagttaatattataaattatctgaggtattttaatatgcaagtcttttttgtgtttagaatttaaacaatacattctcatcttctactttttttcataagcataacaaggaacatgcatccacacttagcagcacctcacatgtatgcaatctgggaggttcttcctaaggaaaagattacaaataaaaaattaaactcaaaagtgaatatatatttaggatgaaatagtcataagaatacaaattttaaaaagctgacagatactacaaagaataacaaattccagaaaaataacaaaaacatttttcctcctcctttgttcacacacttgtagggtgatctgtagttcaggttcatatgctgataccacctctggtgtgtcaacatcgttatctcatggcagactgggaggtgggtgtatttccaaaacatccctacattgggatggctggcaataacatacctcaacatagaagtgactgcaaaccaggtaaatatgttttattaaacctaaactacatgtatgttcagtgcagctcaactttccctttgttagatctcaaaaatgttcatgcttgctccagtgtcgcccaacacaaagagaagtgcgatggaggaaaaaggagagtggaaagaaatagtgatcataactgattactgttaagatatcatgttttgcaacttttatgaaaacatatgagtctgtaaacattgctaaggtcctttcaggagtctgtgcatatgaagggcccagatgcctaagctactttagcttcacagttacctctcaggagaactcagtcacagaaaaatgaataacagcatgttccagatgctttaaaggaaccataaaaaatctgtgttcttttacatttcattccctttattcttctaaattgttatccaaagttattcttttatctctatttttaatgtgttagtattaaactacctaaggaaaattttcctgtggaaaaccatataaatattttatacttttcactttttgtataaattcgtgtacttaattcttaggaaaaatgcttaagaataacaaaatatgtttatcataccacaataagaaaacaaaaaaagaaaaacaaaatccctgaagtaagtgttctcttgtgttactgtacaactgcctgtaaaaatcattggggccactggaaaaagatggttaagggtggattgtgtttatctttttttttttgagacggagtctcgctctgttgcccaggctggagtgcagtggcgcgatcttggctcactgcaagctctgcctcccaggttcatgccattctcctgcctcagcctcccgagtagccaggacaacaggcgcccaccactgtgcccggctaatttttttttttttttgtatttttagtagagatgtgtttatctttagtatgccttgtttccattctgggtccttctaatctctagatagccaaagcttgaaggattttaatacaaagtgtctcaagtgacttagctctattatgcctaaaagtcaaaatggaattgtgcagcaaatttctcacaagcaaaattacatctaaggaaagtactatttgattgtagactgagggtagagttaatatattatacaaaatttatctcatcagtcctctataatagtataattggaataattttatatgaattaaattattgatatacaattaaaataaagatatagacaaatttaaacctctttaattcttaacatgcaccaactaatatccttataacttgtggtttatataagggcttgttacttacaatattaacaatcagttgaaacatcatagttttttatttatttatttatttgtttgtttatttatttattttttgagacagagtcttgctctgtcagccaggctggaatgcactggcacaatcttggctcactgcaacttccgcctcctgggttgaagcgattctcctgcctcagcctccagagtagctgggagtacaggcccacgctaccatgcccagctattttttgtattttttgtagtacagacggtgtatcaccatgttggccaggctggtcacgaactcctgaccttgtgatctgcccacctgggtctcccaaattgctgggattacagacgtgagccaccacacccagccataatagttttaaatggtactgttgacagatggtcatctgttctgtgtgaactctgtctgataccatgtgtcctaatgccatctggaagttttgatttcctcctttggacaggtcttgactctgacctactgagtactgcttggatcctctttctcctgaaggtacatgtcctggctatctggccattctgcataccactctcctcttcttatgcttcctggtttactcctcctgcctaaatcctctggtgaccttcataagacatgtttcatatcttggaacatgcagtgagtgatatagccatgttaacagaatgacagacacacagacagacagacagaggcactctcgtgaaaggaagacagcaacaccatcacagaaggtatgaaaactgaggggagatcgctaatgtcaggtagagctacgaagggtataatcagagtttcctgcccatctccttccttgatcttccaaaggaaatctacagtccaccaacagtctccattcaatactatacctcctccagtgtacctgttctacacaattatgctcccacttttccccttcccaagggataaaagctcaattcagattccccttagcccatcacctagaagtagtataaggcttagtaagaggctctcttgaaacttctattaggtcttagcagagtatgcccatctccttcttaatagctatgtagatagtttatataatcagacattaaataaacatttatatgaaaatattttatataaattaggattcactatagtttataattttaaaaggactacaataggttgtatcttcacttaaattgcaactgaacaagagccctataaaatgtagattttgctttacattttcataattttgtgtaaagcatttttaaataacatatataatgttatatctctgaatagatgccattattgttgtggaagagggaaaataatttcttctgtaggacaacataagaatggtgccatcaaatatcaatatttattcctttacagtcctgtgaaagagaataaatatattatacagcagctccctcttaaacaattttatgataaactattaatcagaagagatgtttcagatatgcaaaatggatgaataaaagaatatagtaagtttatagataaaaccgaacaattttatttatttacaaattttacactcagacaaataatagttttttctatattatttttgagatgtttagcatatactataaaactgaataattgtgagtttttgtccgtattttactgtattcagtttgtctctttctgaccatagataccagtggttctcccactatttctgttatcggtggcctggagggcataatcatatgattttatgaaaaacagttatttttataataggatacatgtaaaataaataatttttatggaattaatataatttttaatgtagcttttaggaatttagttcttttaaagttggacacatttttagcaataataatgataatagtgttgacactataattttttgaggacctcttttgttccagatacagtgcctggtgctaggtattttatgcccatgttatggaaggagctttggaaaggtcaagtaacttggacacctagctagtagttagtggtagaaccaggatagcaattcttgtctgcttcactctgaagccagaggtctttccatttctctggcttgtctcttacagtgtgtctagtgttctacaaaattagggaccttcgttatgggtttttattcctctgtagtcagttgaaaattccattttcctccgtagatgaaactgcagaatgaaggtaaaatgaagtagaggcttggttcttttttcacgtaattttttttttcaaatgttggggttgagcttctccacaaggaagccatggtttccaggccatatagaatcaaggttggactcacatcataattcataatctacatttgtatgagcttccagcacagaatagactttcaaaaagtttcacttctaaattaagatatagaaactttcattcaaaattaagatgtaggaattttcagcatctatatctaattctactttgccatgaaaagaagaacaatcatcctatatagttgtaggatcttactgatgcttccaaggcatagtgggcagcagaaggactggtccctaatgtcagaaagattctaggtcaaatagttaaaaattcaaatttatgacacaatgacatagcatagttttgtaatatttaattatgaatttttaaaactttttgttaaatggatatgacagctttaaattcatatacatcctgttcaggttttgtagtcaaatggccctttccttagccccttctaccttgcagtctgttcttaaatgtgacctacttaaatggatagattctatattctttctagagaaatgcctcattcagtgagacataatttctctaacaagaaaaatgcattcactgtgtaattccaaaacctccaggaagaaggcctctgagtagctacattatagtgctccggaatccatgcactaaaaagtgcatctttctttaagagaggatctctaggttctcacttccagcttatttatgattatatttttaagcttttgttttctctatttctccgttcacagcaattgtgaaaaaagaaggggcatccatccttcattcatttattcagtcaacaaacatttatttaaggcctgttatgtgcccctgaaactgttttatgtactggagccattcacagcactaacagctgacagcaataactcatgaagagattttttaaaaaaatgtaataagcagatgcaacagtataaaacttcaaatagtttaggtacatttagtattatcttcccctattctgagaatgagtagccagccaggtttcttccagaggggcaagtagaatgtctcttactcgaggctgtagtttcttggaaatgaaacaaatgtgaaaaatttcaaaatcgagttgggttggctgtagtaaggaagccagggaggcaaaattaacctgccctcaaaaacagatctgaggcattgatctcaaactggagcataaggccaggaaaggtcaggactaaagagataagaatagggaacacagcagctcagcagctcagcagcttaagctgacaagccgaaaggccagcaaggtaaaaattagtgatagagctggattttaaacattccatttttcatgctcccatgggcaactcctctgtaattttgatataagattattttgggagtgggattctctttgtggggaaggggagtagaagaattaaaccttctcggccatggcaaattcaagccttccttaggttttatgcttatatgtgtgtgtgcctgcgtgtgcgtgtgtgtgcatgcgtgcgtgtgtgtgcatgcatgtgtgtgtatttgttgggaggggcagtaactgaccaattatgacagaaggcaacccctccttttgcccaaatccctcccttggcatttggtaggtggtgcaggtacctgtgggttttcacacctctgtagcctctgaggacttcactggattacaggagagtaataattaatgctaataatgaggactcagtggtgtcaagaaagatgaaattcttttatatatgtcattcatgtaagaaagcaatgactgttagatcttcccccaaccccccaacaaggttaatattttaatgcttgggtatttggaggagtaaataagtacttttgaaatttgcttattgataagagcttattctctgatattgcctgagtagatatattgttgctttatgtagctttagtgatatttctatcgttgagtgaaagtgaatcagggctagcactttaatttgcatttgtgatcaggattattcttttgcataaagattaaaatttgatttggaacaggagtcaaggatttacttcattaggtctgaattcacattttccacctcatttgaaataaaatattttgtaagttaaaatatatcttagctgggaagcaatgttataacaacatttcaccaaaattcttgagaaatgttttaaaatccaaaagtctttctactggtaatattattcccccgctgacttcatgtcaaaaccaaatgatgatgtattttccttaaggcattgtttatatggcaggtcttcaaccatatattactaacagtttgtaccttatcagacctgacaagattacagcctgaagagttatattttgattcatataagagtatggacttgagcttcaaaggaataataaggccaaactattatagttcaaggactttaataaatattaaatgataaataaggctggttccacactggcttcagggcctgtggataataaaagaaaatcttcaaatggtgccaaacagtattatggctgtcttgccttttataatctgtctttactgcttgccactgtagttgtcagagctgggaatgatgaggtagcatatgtagtttttgttgctgacagaattaaaagtaaaggagactttaaaagtaatccatctctgtagcaggataaatacagaaatgtgctttttggtaatactgtagtaggtatttaatcactcctcacctgcctactctctctaaaagtcaggttgtggacttgatgttaaatgtgaaacataccaggtgatatgcattttcattattgttaatttctagttttaatggaaactagaatttacttatatcatcatgtttgggatgtcaaaacatgtcccagtgggagagtgcagaatgcctatgattcatagaagatcactaagttatgtgattatatggaggaaaagtaaatgaagctgcttttcaagagaaagcccatcagtactattgttataaagtctactgtgggctgggcacggtggctcatgcccataatcccagcactttgggaggctgaggagggtggatcacctgaggtcaggagtttgaaaccagcctggccaacatggtgaaaccacatctctaccaaaaatacaaaaattagctgggcatggtggcaggtgcctgcaatgccagctacttgggaggctgaggcaggagaattgcttgaacccggggggtggaggttgcagtgaaccaagattgtgccattgcactcctgcctggttgacaagagcaaaactctgtctcaaaaaaaaaaaaaaatctactgtggcagacaaattctaagatgccctaataatcctgcctcctgttgttcatgcccttgtacattgaaattgggccagcctaggtttttttttctaaccaattgaatatggaaaacatgatgggatatcacttctgtgattaggctaaataagataatgacctgcccttttgcttaccatactcttccctttggtgactttgatgaaacatgttgccatattggcacatgcaaggaactgagggcatcctccagccaacagctagctaggaactcagacccttacctcaacaagtcctgtaggaactgagtactgccaacaactatgccagcttggaagcagatccttcctcagtcaagatttcagatgagaccccagccgtggctgacaccttgattgcagcctggtgagagaccctaaagcaaagggctcagttaagatatgcccaggttcctgacccacagaaactgtgagattatacatatgcattgttttaagcttctaagtttgaggtgttggacacatagcaatagaaaactgatacattagatgtattagtttgatagggctaccacaacaaagtacaacagactaggtggcttaaatagccaattgtgagaaatttattttctcacaattctggaggctcagaagtctaagatgaaggtgtcagaagcgttgatttcttctgaggcttttctccttggccttgtagatgcctgtcttatcctcgtctcttcacgtgatcttccttctgtgtgtgtcagtgcactagtccccttttcatatatggacaccagtcatattagattagagcccacaataatgacctcattttaactcagtcacctctttaaacattccatctccaaatacagtcacattctgtgggaactggagattaggatggcttcatatgaattttatggggaaacaacagttcagctcatacgataatttttttatagttatgtttatctctatagcaaaaactctgtagaacttactgtctgtaaaggtcttttgcttcctttttattctttattttaatgtaattatatatttttcagatgatttatatatataaaaaaatcacatagttcagcacatatattttcatatccctgtctccataacaaaattcaaatctctgtttaagtatatgtctttcatgtactttattattattattattattattattattatttttagacagagcctcccgctgtcacccaggctggagtgcagcggcacgttcttagcacactgcaacatccatctcccgggttcaagtgattcttctgcctcagcctcctgagtagctgggattacaggcaccaaccaccacacccggctaatttttgtgttttttttggtagagatgagattttgccatgttggccaggcttgtcttgaactcctggcctcaagcaatccacccgcctcagcctaccaaagtgcggggattacaggggtgagctactgtgcccagcctctttcatatactttaggtataacactttgcaatatttatggtattgctgttagaggcattttcaaaatctacctttactttttgtgtttgcttgcatacttctaaataagttggaagtagcttgtcttaagaataagtacttgttaaaaagatagggagtttgaagaatttacatttatttgaagtaggtataattttagataatggtaggtccagagagtatctatctttgtatttgggaatccagatataatggagatacactgttagagcctatctaatgctgggctgatttattaagacactgttttttgacactttgagttattaatagcactatacgtgtttaaaatatttttctaaatggccaaaaaaaatctacattatatacattatatacaacagttcattatagcacagacgagtggttttcagagtgtgtctgcagacccagggagtgccagaaactctcttaggggatcttcaaggtcaaaactatttccaaactaaaactaaaacattattttccttttatttaaagaagtgttgacatttttatatgtgttgacatgtgttgcatcataaatgcaaaagaaatagtggatgaaattgctggaggctttgcattaatcgaggcagtggtgttaaactactggcatttgtattttaaaatagggataatattgccaatataagatggtggttgtaagatttaaatcagatattttgtgtataagttttcaactaatgaccactatacactgctacccttatcagcaacatgtgtttctaccatatttttgtcttctctctatgatttattttgtgttttgatgagtcattttggttatatttatgtttataggtacctccaccaaaaaatcaaagaagaatattaagataattcttaaaacacaagtctatagtgtttcatgtttcttcaaagaaatggttagggaaacatagaaaggtaaagatgagcaagcaattagggatttttggaaatctttgatattaggaagagcatcatatacctaggaagttgagccaacaattgtaaggagaatggttaacagaacatatgactgaacagagaacattctccattagggataaaatataattacctgacttagcacttattccattggcaattcaatttccatatatgcatcctctgctctaaattggtatgtctatactgggttatttaacttattacaataatatatacttgatgtaaagatgagaaagaatagtattgttttgtgcaatttccactattttcccgaagtctaaatctagcactgttctatactgcactctgtcaagcatcaagtcagtgaaaaataaaattagattgttgaactatgtgctattcacttaattctaaatttgaattatcattgtttcaaaatgaaatcaaaggataagtaaatgcaaaggccttttgtcattttgttatgctgtttattgtgttttattattttttgctttatttttgccttattctgtttttttttttaacagatcatcagaaactagaaagagaagctagaatctgccgtcttttgaagcaccctaatattggtgagaacgtatttttaatgttttttaaatgttaatttaaaattttatgttatttaccacaataaaaatgctaattttataatctagaatatttataacttttaaaaaataggttcctaactttcaatcttggttacatttgatacctcaaagttttcctgtgtttgctgtttgttttttgatgcaatctttgaagtagaaatgtgaaaaattaagtttgtggaaacaaagatactaaattaattaatagtgtatgttttctgttgtgctgaaagttgtgtaccaaccagtggaaaacctgagtgtaatttaaagaataaataaataaatttaggtaatccctggttatattagctttattttaaccacataatttggagtctgctatgttaatgagttcaatgtcctttctgtagagtcgtataatgaaaacaataatcctttacctaattgggaaaatagttgtgaaggtaaaaatgaaacaagtataacaattttttgaaaagttatatatatagtttttcaaaaggttgtgattatgtataaacacttcaaaaaataatataaggtctcatttgaatagtgcttttatgtgtctttaagaattgttcagctacaggccgggcgcggtggctcatgcctgtaatcccagcactttgggaggccgaggcgggtggatcacgaggtcaggagatggagaccatcctggctaacacatgaaaccccgtctctactaaaaatacaaaaaaattatccgggcgtggtggcgggcgcctgtagtcccagctactcgggaggctgaggccagagaatggcttgaacccgggaggcggagcttgcagtgagctgagattgcgccactgcactccagcctgggacgagagagcgagactctgtctcaaaaaaaaaaaaaaaaaaagaattgttcagctactgctgctgaagtatggaaagacaggatttatgtcatcactttactcagctaaattacattccatatatcctgtagaaagtttactttaggccaggtgcggtggtttacgcctataatcccagcactttggaggggtgaggcagaaggatcgcttgaacctaggagtttgagaccagcctgggcaatatggcaagaccatatctctacaaactattaaaaaaattagctggatgtggtagtgtgcatgtatggtcccaggtactagagaggctaaggtgggaggattgcttgagcccaggaggttgaggctgcagtgagccatgcacttcagacagcctgggtgacaaaatgagaccttgtctccaaaaacaaaaaagtttaccttatagttattgatttgattctagaaatagtaaaaggactttagaatatttatccctcatgaattataaaattgcatgacttttcaaaatttttaaaatgtgatgaatataagaaacaagaaaaacacaggaaagaaaaagtaaattcagaaatatgtgtaaactggattctgtgataataggtttgattattttggaaaaatgttactgtcccagctccctcaattttattgttaacctaagtatttctgatctagaagcagtgagaaaaggggtaacagtgatgtagaatttgcaaaatctttcactgaaaagtttacaggtgttttaattttatgtgtaggggcattcaatttctattcctgctttgatgtttttagtattctgcacttagtgggtgcatcttagggtcttaaatgaatggatactatgggtaaaaaaaattgtaacactggcaaattcacctatatcattcactcactcaacaagttacatttctaggtgtatagtaggaacaaaacatactgccagctgattaaaaggaaccttctggtttgaggagagaacaaaacaactctgacatataaatctacctctctagaagcattttactctgacaaaaatttatggcatttcttgtttggctgtattggtttgctaagactgccagtaagagagtaccacagactgggtggcttaagcaacagaaatttattttctcatagctctggaagccagaaatctaagatgaaggtgttgtcaggtttggtttcttctgagacctccttcctaagcaagtaggtggctgtcgtctcactgtgtcttcacatggtcttccctctgtataatgtctgcgtcctcatttcttcttgtaaggacaccagtcatattggattagggcccacactgataacctcattctcacctaattacccctttagacactctatatgcaaataatacagtcacattctgaagtgtgctatcaggattagcatatcaacataggaatttggggaggacatcatttgcccacaacattggctaaagagaaattacgcaatgaaccactatagttcaaagattacttctcttgctcaggtttaagataaaatcaaatctttgtttagtgaagttgcaattcctgtgcagaaagttgttatttgtttgttttggtttggtttggtttgtatcaggtcctcctatgaaactcaatttttgtggataatgaaactagtttcctccatttcctctaggataccaaagtcaaacactcgaaaaactgccaagctaaaacaagaactcttttcattttgacactacatacagactaaacttataaaaagagaaagaatgctggggaaagttctaaacttttgtgtcctagatagcattgtcaacaccttctgacacagtgtacatctttttgcgaggatccataacagccaaatgtcataattccttggttacctcactggaggttttctttaaccttttaagatttcaggagtacaaaaggaactgtgacaattctaggtccttgaaccctaggacccatttctaaccacaagagagatttcgagtgatcctttatctcagtgtataagtcatagatggattaaatttatgagacataatctcaaaaattgtaacactggcaaattcacctgtatcatttactcactcaacaagttacatttctaggtgtatagtaggaacaaaacagaccaatatccctgccctcatggagcttgcagttttgggggagacaggcagtaaacaaagcattggatattagatggtgataattgttgaggaaaaataggaagcagagagggaaatactgggtgttggggtattccagttttaaatagttggtcaggaccatttcatagagaaggtgaaatacatttgaatgcagacctaaaagaagggaggaaggaagtcatttggctctctgggggaaaaacaaacaagcaaacaaacgaaaaacattgtaggcagagggaaccaatagcctgcataagggccctaaggtcagtagattccaccaaagctttttatctaatgagagaaataggagatgagttctttctcattttatcttaccttaattgatgaatctccatgacatgtaatctgacagtgttgtgtttattcatgtaaagaacgattttaaaacatcaataacaacagtgactgtcataaaatagtaagcaacagccaacaaaggaggagtgttttaaagacagatgccataagtggacatctgcaaatgcattggagagtagttgacccagggtgtaaggaaagtactgcagttcctgtcgatcatcgcactagttaacagcaccacatgaatcactagtactcaatcatgactgaatcatattacacagggaaaacagcatttgctcttgatttccctgacataggtaatatgatatctaagtaatatcagactcttatcctcttctccctgttctctattttattatttccttggttttaaaatcagctaggctttagaactttaaggaaggaaataactatttttgaccattttttcccctgtgaaaatgtgcttgtttcatttttatatttgaatgtgtctttctcttggcacagaatcaataatcttgaaaacttgcagcaagcaaaaggtttcttccaaagaaacacattttaaaccaactaaaaatggtgattcattaaactactttttttcatgtgttattttttatgtttttctgaccttaaaagtaatactgttagtggaaaatttggaaaatacaacattgtataaagaagaaacctgagggctcaacttttaatatttgatttattcatttttgcctttttataatcttatatatatatgctaattttcagcattctcttgtgtgcattttcatacccctttagatatatcatgaaaatggtctcacccaacaaaatttcttgagtgtgtagccattgccaagctttgttctaggctatatgcactggtgatgaaacagtgattgagagagacaatggccctcttttcccaaagctttgcatcctagtgtataaacaaaacaccataataatgtcgtaaggatttgttctatgcagagaattaaaatagggtaatttgataccaggggaccgggtggctactatcaaaaacaaacagagccagacaccagttaaagccgatacagattttattttgtactattgcaattgaggaaagaactgaacttcattccaaacacagcaatgacagctggggatttatagtcaaggagcagagtgagggggtcagtggatggaagatttttaagaggagacatcaaggatagggagttgctgaactggactaacaagattcttgctaaaggcaggccaaggacttagacattaagggtagaggatgaagaccttgatgagatatcaaaggtgggaaatcacttcgtaggattcttcatttaggctggcttaggaaggttagggacattgtccaaggatgagatctagttgaaaagaggaacctgcctgatgtttggttagggagagagtcttggtcactgctttagagcgttttgtcaggcaagatatatctatggaggtcacatttaaactgatatctaaatgacaggtggaagccatcatgaaaaagagaaaagagtttcaggcacagagagccctccttgttaggggaaaagtagggaaaccagtagatggactgccatgggggaaagggagtgactgaacagggcaggtagatatttaaccaagtagggtttcgttaaccagatttgggagtttgggtttcattctacatgcaatgggaaaccaatagtgggattttaagcaaaagtgtatcataatctgctttgctgtgtctgctatgtgtaaaatggtttcctagttacatgagcacaatcagtgataatagtgttcagtcaggatatcagaatctagtcttatcagcctagtacccctgaactacatcttcttggataagaatttaaacagctccaggttggttctctctttggtgtggtccacatgatccaagaaagcaccatgcatcttttggctcaacaaattgtagagtacagcccgtttttaaagaagctccatctttgctgtgctctagccaggcaatttttgtttgaacctcaaactggaaagattatagctgacattaagatgttgaagcaatttgaggagaacaccttactttgtgcttagcttagttaatgtttgatcattctgttcaccttttattttaataaaattggcttatttttctttgaggaattaacaaatttgttgtaagccagaaattctgagctatatgtcaacatatgtatcaaataagtaaaagaaaaatacctttcaggtattgaaataaaatatttgaggtgatagccaaattctcaaaattatttgatattcatactgtttttattcttggtctttgatttgaggaatttatttaaacttatggtgaagctcagataacaaacaatggtaaagagaaaataggaaaacaggaaaaaaattcatttaattcaaccataagagtccaaaaacagctgggccaggaaaggaaaagaaaaaatattgagaactttgatctgacttatctgattgtcccaagagagaagatattcatgtatgggcctttatttgggaaaagatcaatatttgagacaactttgcagttcatgggatgatgaattctgttgccgggttgtcccattccctaaagacttgtgtttacattttgtgtagactttagaaagagcaaggtaattttttgaaagtttgaagcaacatttatatttgtagattaacactatctttataaggtaagcgtttcccattataatatggcttaatgaacttcagcagctagagagcaaatggaagagctatgtaaccttttgaatctagtctttagtgataccctggaacccctagtgcagggaatgaattaacctttctagatcacgtcatagctcaatgattacctcctctctactggctttcctacccactaccccaaaatgcataaacacactcactcatacactacaaagtgtaacagataataagaggcatagtgttaatggaaagctctatagattcactgggccacagtttattctccttctgatgctggcctgctctgtgatctgcttatacaatcccatccactcaccaagttctagttcctctctttgtaaagcagagaaaatatttgccttttttatttccttccaagaatcaatagaatgaggtaatgcatcttactttggtgaggagttaatatattttgtaagacgattaatttaaataaacagttgagtacattattatggggtactgcttaccaagtagtaactaattaattcatttcttagcatttagtagtgtctttctgagatgtgcgtattcaacaatggggaaatatatttcagaaactttcaaatatcatatattctatatgatatatatgttgtatatagtatataatatatgatatgtattacacataatcagataattgtaatattgcaacagcagatcctatacattatctagcataaactctaatttttttgttttaatatttaggagagctaaaattttccaaatgtatatgatttgtccaaagtcacagttctttaatgatattgccagacctaaattgttgattgcttctgtaaagagatggcgatgtttagggaacctaacttgaagcagcaagattgaaaaagcaatgtttttgttcccttttgaggagagttttgaggttgtttttggttcaaatcgattcctcccctcacataagataaacattaactaaaaaactttcaatattaatacaggaagagaaagcctttacattttagacagcataagttacagctacctaccatatatattagccctggtatagaaccagtgtgtttaagaaagatgctctgcttaaagatgatttattgtttcacatatataacagtacataaaatttcatgtgctgacaggtggagattaaagaatatataagagcctttactttctataaaagcatgtttcccattcctatgagtaataatggcatttaggatctatataattttcttttcctaaaatttaaaactggaagagctcttaggaattacctaagaccaacctagattctacaaattgaaggtttaagtagtgaagtaatatgcccaggatcatacccagatctaaaaagagatgaaaaacacacaatctgtgtattacttcgtttagcacgtagtgtttcttctttttggtgactttggagatatgatgtcatcctgtaaaagtaatattttaaccacaatcttagatctccctagttttcacaagaaatttttcgctcaaataccattcctcaagtttttatgaaataaattaactgtcattttttgtttgttcttttgtctttagcagatgattttaaccataaattttgcctttttatccttctctgcatgcagttgtcttctaggttcctcaggttctgtaaggaacccatacaatcacattgtacaggttaagcttactaaatatttctcttaaatatacccagtatttacttataaatgagtaaattgccttatgtgtttattgtaccaatattccagtttttgaacccttggaaacaaaatcacataggaaagaagagtagagttaatgcagagtaaatgttaattgatctactgagaaaacaaagttaatagttttatgaatgacaattaaaagtctttttcaatggcatcagaagttgagcaacagtctaagaaagcgacgcagtttttttctgtgacctctcccttattgatggttctgcctaaaaattagagtagtttgtaatcaaacaagagtaagtaatttttcttgttaactactttctctagtgactctctaacagattaaaagtattttaatactatttagtagcaaaaagcaaattatcttattttatatttaccttatttgattaaatctcagctctttattatgattatttggtgagaaggccaaattacttcttagaatatataacagtctgcaaaattgattattctcttttaataaatgtgagaactagcacagcgatatatttttctcttcaaataaatatgttcaaaaaattctaattatctgttttagctttttttcctttgtttatacaatatggtgccagttatgtattctttataattcttggtagaaagttaaatttatcgtctttttaagtaaatgcttattttactaaaaagacaaaatttgaatataaaaattgtatattcaagataatgcttcaaaatcttttccattggtgaatttgaatctgagtacatttgttactggtttctttgtcaatatttttttccatgtatcaatgaaaaagccacttcactaagttaatttagaagtaggtagatttatacatgaaactggagaaaaagagtccttctgttacaaatgaaggatagtttcatttttagagttacttatagtacatagattacactttgatctatcaatgcataatatttactgaaatagttctgatttattctactaagcctatttgatttccatcttgccctgtctccactacattcagggtagaatcccctaacagggtattggaagtttatagtaatttcttcagctcagaagtcggccctaaactgaaatttgaaagaaaaataatcccaaacatgaggagtactttgttttgttggggcttgagttgtgcagaatcccacctccactcccttttctcaccatggggaagaataactcatgtcgctagggagcccagaagatagttggggaagtgataacactttttgttcacttaaaaatcattcctcttttccctttattccagtagcattgataataaacttgcctatggtaagtacttgtattaagatgtgaagtaggccgaattagaaaaaaaaattagattggaattccaaagaacttcaccactagaactaatgataaaactattaactgtgttatcaggctctggtctaaagtgttttccatgcattagttattttaattctcataacaaacaaatatcattcttgtctccattttacaggcaaggaatctaaagcctaaagaggttacacaatttaatcaagatcaggcagttagtaaatggtggagttggaatccaaacctgcatattctggcatgacaatctgtgctcttcaatactgcactgtatcgctgctgtataactctgaattagtcatactattctttaataagtgcagaaaataattttaaaattttataaacattgattaaaaaatccttgcttaaattatctaattttagtatttattattagtccttgttccagagggaaatattagcatgacattattattcaaatgcttatggaaaatataggtattatagaactaattatattttaatgacaatttttagtatcttggtaaaaaatctggcttatcttttacatcttttaggtggtcacatctggccctgaattaattattatcgctgtacaagacagtcttttacttttctctcttactgatcatgaaaatgaataaaataattgtcagaaaacaatgaaggctaaggaaacaatagtaattaatataatttgtacaatgtatgacaaaacattttaaaactctgctttacattgtagaaaaagaaatcaggaccagatagtaatgtgatgatgaattcttacatcagataagccctcaatttttttaaaacaatcattgcttataacttacttagagtatacagaggaataccaatttaggggtttgagataacttttgaaagtgtactttagagttcaattatagcatttctttttgtcactttttttcctagctgcagtttactttggtaggaatttgccacagtagaaaaggtagcttcatattcttattatttacacatttgaacacaggaatttgttttctttaaaaatgctccataggtagaagtgtttgctctctgaatttgatttatagtacatcagtttaacaaaatcatatctagctctaatgagctcaccatggatttatgatcatgtcaggttattgtttgaaataacttgttaattttattatttagtttagaagtctaatggtctatgttgaaggaaagtaaacagtgatatgacttgaattctcttaaaatattctttcacgtttttcacttcagtagtaatttataacatatcctgtgaaatgacagaagattttgctcacactgttgaagttcagtagtttttataattcagtctccaaagattactttcagtttttagtgatgggctattgtgtgttttaaccaaatgcatagaataagaggaaaaatttttgtagcataccaagttgttcaccaaagaagataacagtatgtttcgtgagcattattttgaagtgtaggatgtcttttctttcacttgttctgttcagaaaatgatattacttactaatacatgtgcagaatctcattattttgtaaacactttccttgagacatccataattattatttccataggcataggcagttttgcatattcacatgaatttgtgttggatatttgtcaaaaaacatgctatgctttgtcttatctatttttcatttagagcaaaatgctcactttcaaattgaagtgataaaacatcccattatattttgattagatctggaaatgttttttcgaaatcttttgaaaaatttaataaatgaaatgttaatttaatttgtttccacccattatatttttctctaatttctttttttttttttttgagatggagtttcactcttgtcatccaggctagagtgcagtgtcacgatctcggctcactgcaacctctgcctcccaggttcaagctattctcttgcctcagcctcccgagcagctgggattacaggcatgcaccaccatgcctggctatttttgtatttttagtagagatggggtttcaccatgttggccaggctggtctcgaactcctgacctcgtgatccacccacctcagcctcccaaagtgctgggattacaggcatgagccaccacacccagccgtctaatttcttaaacaatcattagattagttttatgtccacatttgatattggaattaaaggaaattatattaatctggggaaaggtaaaatgaaagataagaaaaataaaactatacataatttggaagttgtctcctatttctttgtttgagttgaagtctcactctgtcactctggctggagggcagtggcacgatcttggctcactgcaacctctgcctcctgggttcattcaagctattctcctgcctcagcctcccgagtagctgggattacaggcacgtgccaccacacacagctaatttttgtatttttagtagggacagggtttcgccatgttggccaggctggtctcaaactcctgatctcaggtgatctgcccacctcggcctcccaaagtactgggattacaggcatgagccaccacgcctggccagttgtcttccatttctaatggttaagcttgattgagttgaatagcgctaactctgttgtagctaaagtactggtagactacaaagatgaatgagacatattccttgaccaaaaagagttcacaattttaaaggacaaataattatgtatgcaactgaaatatagtgtgattatatactataatgaaactactaataaggtgccatgggagcactaacatacaagctaagaatcttaactgaaatatattggatggtgaacagaattttgccataaagttgtagggattggactgaagagcattatagaaagacaggcccacaaaagaaaaaatagagttaaaagtctttgtcgcacttgaatgactgaaaacctgtaatgattggcgttattatatatgtgtgtcagaaataaaagttgattgagaataataatggagagtctgggaaggaatttgatttttaatctggagaaaataaagaattaattaagatttatttagtcgactcatgattatatcagttttttaggacagatttagtagtaataagcataattatgtggtgtcaggaaaaattggtgttgaaagagcatctgaaagtctctggagtgaatgtaggtgtaaggcatgatgagttcctcaaccatagcaatgggatcagggatggcaaggagggcaaagctaccaaagatgttgctgtggaatcagatcttgagcaacaattaacttgtggcagatgggctaagaggtttctttgaggtttctagtttgcgtgactagagagatgttgatccctttaactgacaataggcaacaaaggaggaaaaaacattgggagaaattagaaatttcactgatttgaaaacattatttttttaaggattggaacatttccattatgggggaacatggacaaaaaaggaagactagaagtcgcaaatgccactacccaaacccctgatctttcactttttggcagaagatataagcttcttaccatgtgagcatcctcttcaggatggaaatatttggctgtgactgtgatcatctttcttagactaagactgaatgctgctgagtcaagagcagtcaagttgggtgctcaaagtatctgctgaaaaagcaacataacgtctgtagcaactccatcaccacctaactgtggttgagcacttatttctagggtgctttttccccccattctgtccactaaagtaaagctcacttcttaccggtcccttgtgcctttcccaaacatgtatcttttgttggctcaactactttcatttgtgtatatcccatcagacttgcatgtgggataccacatagagctgtagagagtatgaatatatgttttgagtcatctacatgtatgggatagtgagagcatatgaacgtgcccaacagtatattaccaagggggccatagacagaatgatgaaaatgcttatttgtaaaaatttgacttcttttaaggagcaataacaacagccattttcttagattactttcattctgaatatattttaaaacatttaatatataaaacagctaaatttttattctagatgaataaaaggaaattatatttgggaacaaaatattttgagatgtacaaaaatgcagtataggcttctttttacaataataatccaactaccccaattttaaatagggttatatcaatttatactcttagaaaagtaggaagactataaattttaactacagtcttaattttgttaaagctataatgagttactattttgaaggtcattatttccttctgccaatctccttctcccaaataatttctcatttaaaagttgtagtgccaaatgtgcatttaagcttatttgttaggaactctctaagagaactctgataaaacatggttttcaaatgttattctcatatgtgttgattattccagtgaccttttcttttgatatttcttatataaatctgccattcaaaattaaattacatcttctggtcattttctaagaatatattcataatatggatgagagaaaagagatggaaccatttttcccccacagaaagacagaggatcattcatttaaggtaacagttttcaacctgggatgattttgccccctctactctctcttccttccggagacatttgacaatgtgtagaaacatttttgactgtcacagttgtgggtgccattctggcatctcttgggtggaggctgctaagcatcctacaatgcacagaagagcccttcacaataatgaattatctgctccaaaatgccatagtactaatattgaggaactcagtgatttaaagtaagagttacaattacaacaaaaagataaatagccagcattatttgatttacttctggggccatgcaattttctttttcataaaaaaagtaggcagtgcatcttcttaagtaaaggacaaatctattaaagaaaataaactgcttttgaaacaatttatattgtatctaattaaattgaagcatagaaattgtacggtaagcagagccaaggtagcatagtctgatgctgacatatgctaattacaatccttataaatctattcatcagaacagattttattaggcaaccttggcaatcctgattccttcacacacaaaaaggtaatgaaagctatttaaatataatagaataatttagtcttttaactaattttgacgggtcttttccccaattaatctgaatcagtgatgtgttactatggtgtaacaactgcaaaacaccttccagtgaaattttttaaaaaattatgtaaggctatcatgaggtttttcggtaaactagaaaacattattttttgagataataaataggttggaggtttatgatgcagttatttgtttttcatttgggaaggttttaatgtttaaatggtgaagtgacaatatccgatttaattttaacaggattactctggctactgcaagtctgaccatgtctttcctctcctcggaaactaatcagtggcttcccactgcactcagagaacgaggggatggcatgcaaggcttgcaaggccttccacaatgaacaccctctctcccttcttagcttattgttcttctgatcttagcttctctccccctcagttgctctgctccaacccctctgggctccttgcatttcttcacctgttcctgatatcctcctgctgggcctttgcctggagttctttctgaggatacagcaaggaggcatgctggctcacttcctgcaggcctttgctcatccaaagtggaggcctgccctgacagctgtgtgtgaaagagcagccttcctcccccatgccccacccagcactccctagcatccttcttgctttatctctgatgcacttaacaagattttgtatatttacttgttgatttgattgttttctacccagtagtatgtaaaacttcatgagggcatggacttttcttgtttattattgtacctaaaaaagcacctgccgtagagtctgcgctcaataaatacatgctataggagttaaacaacgtgtgggtacatatattttttttaagttcaagtttagattatctgaagaggaacaaacacttctattaagagaaaagcataaattttaacttatggcacagctgttttgtttaagttcatctgcaggcttttgctttccttctggctaaaatgactatcaatggccctgggctggcccacacctaaagactgtaaaacaggagagcaaacaattgacttctccctgacttgctaagtcaacaaaccacatgagtcagcaaacctctttttactgcctgaccttccttaacatctccttatcgtattctgaaattcctattctgctggctggaatcttggcccagacccttttggtgatctttgatgtgtttctcatacaccctgcagcatttgaatcatctttgtcaggagtgtgaggggctcatggtctcttttatgtggcagacacctaaaactgctagctgcttccttaccttcctcgggagcattttgatgatactccagaaagcagaacagcactatcaataaatgtcatggatttttttttttctccttgctggattacctagcctttcagataaggttggataaaccttattctagggtagccctttatttgactactctacccttccaagcaaaaagctgcttttcaaatgaagttatcaaactacagtagtcaggaaagaaagagaaaggttggttatctctcactgtcacttgggagctctgtcctggaacaaggattgacaaacttttctgtaaagcacccaatagtaaatattttgggctgtgctggcagtgctacctctttgtcattgtagcacaaaaacagccacagaaacttcataaatgaataggtatggctatgttccaataaacctttacttatggacactaaaatctgaatttcatttaatccatctcaagatgtaaaaaacattcaggccgggcatggtggctcatgcctaaaatcccagcacttttggaggctgaggcgggcggatcatgaggtcaggagatcgagaccatcctggctaacatggtgaaaccctgtctctactaaaaatgcaaaaaattagctgggcgtggtggcgggcgcctgtagtcccagctactcaggaggctaaggcaggagaatggcgtgaacccgggaggtggagcttgtagtgagccgagattgtgccgcttcactccagcctgggcgacagagcgagagtccgtctcaaaaaacaaaaacaaaaacaaaaaacaacaacaacaacaaaaaattctcagtacaggctgttcaaaaataggtggtgagctgaatttggcaattgagctatagtttcctgacccctgctctacagtgagatgacttcatctttgtggattacttggaccttggaggtctgctgaactccctaatgcttttttttcttggatctgacaaatagctttatttgtgtctcccggccactttgtagattctgaatcctagaagggagaagctaaaatatctgggtgcagtgatgatctgctttgcttcccacttctgagtttctctaattctggaagatagtgtcatttcaactctgatttctggtttagctcagctctcaattctaggtctaatgtgatacaaaaagccttacacctgttgcttggttttgtttcagtcttgctgttggtcttattgttacctaccttctcggttgcccattgactagatttcttgcctcatgataaagctctggataatagctgcctacctcttggtgccttcatctgccaaccaccacacctaggtaacctatgaattttagacttaagctgagactactcaaggcttccctttattcattttccttgggaactgatgatctatttcagattacctttgaatttacacacaagtgctgcttctagaataattttgactcctgacttttgctcttacttttaaacttttgtcccatttatgatataggtcagctttgtcttcatttggcagatttgtaaccatctaagccaagaatctgacaagatattattttttctgtttcttctgattttattgaggtctttttctttttgaacccatctgtttccccatctttctcaaaacaccctgagtataccagggtctgcacgtcttatgaagtcaaagttagaatcacttcagttgtgagcttgcctttcttaattacacaaacttcttctgacaataataggtataaactagaatgacataatttgatgtaatataagaccatttttcagagtacagaaaagcatattgtattcaccttgatttgcaaatatctcatgaagagaattactttattctttgggcctatttttcacttgtaaagctggcctgggtccccataaatactctgtccagtttaatttgagtttaacatgacactgaggagtagtctgatattactcagagagggtgatacaactctgaacttgttggcccttatcagatataatttaaatttcccctggaaagggaaataagcacttggaatcaaggcaaagagccaaatccagcagattatcaagatggtcggtgggaggaaagtctgatggtttccgctgctaagcgtgggagatactgacctactctcattcacttacttttgtacatagatgtagactgtgagctgccaaaatagagaacaattcttactttctgtcagcagcttatcagaattccctgacctccaaaaatgatgaacacagtccggaccctgttcttatgactggtgattgatacagctggcttagctcttgttttttgacttgcttttattgggccctggactatttgttctacacactttaaatttgggtgcatgagcacccaggtatgacttcatagacagccctgtttctgatctgaacctatcatacttgcctctggctttgcccttttatcctcccaactctctacactagtgcttctgcccttgttggactttttttaaaaacttttttatcatgtttgtatcttatatcttggaagacagaattatccctttctattgaaatataatacttttagcatatatttgaatgaatatagattgaagaaatgtaatgtcacttgtcttccaggaaagactttcagttttgtggattaaaacatttggtattttgattgtttaatttctaatcttgatttataggacacagatagtttctgctcttcttttgttacatatctatttgtaaatgatttggtaatactgttcagatgttccctttttctagcttttcattttaaattgtagtatctttcttttattttatagatatagtttagcatggtctctgctatggtttggatgtaacttgaccctgcccaaactcttattgcaaccataatttccagtgcagcaaggtgtagggtagaaactgtatgagagggggcctaatgggaggctttggatcatgaaggctttgcccttgccctggtgggcagttggtgcctttctagcagagcgcgactccatcttgaaaaaaaaaaaagaaaaagaaaaaaagaatgtcccttgttctaaccagcttccacagacagccttatcagaggagaagtatgcttttgccatctctttatggaaaagaaaataagcctttagcctagatggctattgttgcccaaaaaagggaggagggataaatagcttcactccgctgctaagttggtatcagtttgggtttaattcagccttagcatgtccatctgtccacttctgatgacacttgtatgtgtgaggaatgtgggagacagggaatggaggtgagtggacattctggtagtgttcagatatgccttgattttctccaaccctggaagggagtagttctggaatcctcctacctgtccctcaatttttcactttactaagattataacttatagcttccttgagatagaaatgactctgcagagcccatcctgaatggaaatcataataaataattcctatatccagggaagtctgaaaactaatcttgtttcctgtttttggagcacagtaactggcaaaatacatttggggtgagtttgacttttagagggtggttctgaagcattcttatatgttagattcccttgataaaatggcagattcttgagcttcagcattacaaattgatctggagcgggctctaggaatctaccactttttaattttttgtttgcttgttttatttatttattgtttattattttttattatttttaaatttttttagactgagtttcgctcttgttgcccaggctggagtgcagtggcatgatcttgactcaccgcaacctccacctcccgggttcaagtgattctcctgcctcagccttcctgagtagctgggattacaggaatgtgccaccatgcctggctaattttgtatttttggtagagacacggggtttctccatgttggtcaggctggtcttgaactcccgacctcagatgatccacccacctcggcctcctaaagtgctgggattacaggcatgagccaccatgcccggcaacttattattttttaaatcaagcacccaggtgattgtgatacaggttttcaaagccacaatttataaaaaacgttgtgctagtgataatgttttagaaaactaaattcccagtaaagctttgagccaggaactttctattaaactctgtagctctctaggctccctgtcctctttatcactttcgtaacaggtctagagaatgaaatctgcaagaaagaaagatccttagatagtgtcaatctgaaacatattgtatctaaacacttaacataattatcttatttaattttctcaactactctgcagatataaatattatatcaagtgtttttaatttagttcagtaaatatcgagcctttactatgtgctctgtacagtgaaaaagttcagtctcaaatagatatattaatttgactggggttgcttagtttatgaagggtggaaccaggattcaaatacatttgtttgattccaaagttcatgtttctactctacaagccttctgttcttcacttcctcatctgctcaaagctgtgaaagctctctgtgcagctgtattactttttatttaaataaagcactagaaggtgaacaacatgataccaaacactgttgacttgtaaggggctttcttcctgtaagagaagttaggacatttacacatgaaaatactcagcagttcaaagaagcatgtaattaagtgcccaaattagagatataaagagagaggctcatattgtctgtggaatgttttctacagagcattgaacacatttaagaatctgaaaggataagatttagaaaggaaggaacaatgttgtctccaaattatgaaagttaaaatgagtctgtctatggatgatgccaggtaattatccttctaccttataaaagttgtcaacagacaattagctatgtaagtaattttcccctcattcctttcttgttgaacagtttctgaaagagaagcactctattgtcatttccttaatgcacatttattttctaagcgtctgctttcaggcttcttctatgtgttcctaagaaattgctctcatagtgattatcaccacctccttattactaagtccagtggaaccttcttgttctggtcttacttgatgtctctctatagttgaatgctccataccttccccattacaatactgattaggttttgttaggactatttacctaatcatctaacttttctgatagatagtaagctctctgaggatggggattgagtctgtcttgtacgtaaggaaacaatatggcccaggaaaccatatgagttacctcctttggcttttgtaacataagtattttctagatttcttctttatctccaaccattcattcctaatctccttcgtgaattccccttctgcctacctcttaaatctacgcagggcatttcattcatatattagtaactcccaaatctattttagaggttttaacgtttctctccagacacgtttcctactagctagtggaatattcacttggatgctattctggtactttggtaatcatactgtgcataaaatggaacttgttttccacccttgccccactcagctcccacccagacctgcttctctgcttgtgttccctgctataagccttgcccaagctagaaatctggtgtcatcctctctacctctccttcccttgccaacttatataagcacttagcagttctcccttcaactttctcagtggcttttaaatctatcccctccccctaacccacatgctttaataagccttccctcttctgaattcttccctttgctatgaagaatggggttttttaaaaatgcaactcggatctgtcactctcctcaaaatcctcccatggctccctaatttatcaggctaaattctaaaatcctgacattgcaaagtcctttatattttgagttcccctatttgtttgctactctccagccatacagactccctccccaaaactgtaatttcttatttttccatcttctcttggtacttttccacttacattctcttggtgggagacgctcttcttctccctcccactttgtctggctgaactcctcctttctgtttaggcctcatctttggcatcaccccccagccttccctgatgcccctaattggtattctagggtgggtgttgtagtgtacaaaggtgcctggctgaaggagtgagtcagcgctggtgcagggcttcctttttctgatttgcacagtggccctatgcaggctagtagtggctctggtaccacattacttatttacatatccttattccccccacaaaaagccatttggccttagggacctcattcactttttatcttcagggcctagcaaacaaattgtcattagatccagcacagagtatggtataataatcttgcctattcatatccactgctttcacaatttactatgcattttttttctttttccttctttttatttttgtccttaagagacaggatttttctctattgcccaggctggagtgcagtgaagagatcatagctcagtgtagcctcaaattcatgggctcaagcagtcctccctcagcctcctgagaagctggggctacaggtgcacaccaccacaccgggctattttttttttttttttggtagaggcaaagtttcgctatgttgcccaggctggtctcgaattccaggcctcaggtgatcttcccaccttggcctcccaaagtgctgggattacaggcgtgaaccaccgtgccaaacctacatttttatatttattatttttttctgattaacaataaagctaggttattagctgcctgggaagaggaggaagtagatttttacattcacttttaaataaacttttaaattcacatgagaaattccaccttaccacaattgtctccctaacatgtctttggactacctctgtttctctaagtttttgtttttttctggtgtctgaattaagttggtgacagatttgggggatatttgagtagcactttatctagagttgcttgcacaaaagctgagtaggagcatagccctaatgagttcgcattaccgaaacaggtccctgtttgctgagagtgaaattcctctattattttcttaaaccccgctttgctaaggttataaagtggtccaactgcattctacctttaactccaaactgttctcttaaatatgtacctggcagaactgagagcacattgtgttttgcatctcgtaggtatctaacctacccccaagggagatattctctatgggaatcacacctcagaaaagaaaataatatactttctcctacctctctcattgttcgcaggctcatattctccaaacctctatctcatttttcttcttgtgctctgtggttcccactctcaaattttctctctctctgtctctatccttctgtctctgacacacacacacatacacacacacacctgtctttctagtcagagctgtttctgtgttcctgttcaagctccattgtttttaacctcagtcagccttcccttttcttcacttgaattagcttcttcatattatgcatgggtaaatgcacagaattatttgagtgcactgttagctcttagcttcagaaaggattcagaaattagaggagtgatcaggggagccagctctgaagctacaaattggaaggcactaagagatgagtggatgtgtaataccatatttgggagaaggaggatggagagctatatgtttggttaaggatgggcttggacaaggctgctattctttcttgcttttggtccacaaactggtgtcaaatcctggaaactgtataaagatttagtatttattattatttagtatttattattatttcaaaaacatttcaactctggtatgtccaggcagcctatctctgcatggtagaggcctgggaaccaacctatggattaaaaaaaaatgtgtacttttatagtttctaggaaaaaagttcagattatatcttcctaggtagatattttatagaaatttacatccaagtttataccacagtaaatctctaagggacagatttcaaggaaaccccctgaatagttggattactgttttcttgcagctaaaaatttttgattatgtgcccaaaccaaaacaaaagattgcatttagcttcctcgatgagaatttctgaaaccaaatacaaatgaaaccacaggaggaaagataaggactcacaagtttatgaaacttgctaatgggactttaactccctcttagactcactcactcaactttcttattccatttgatatattttattttacattattttgaaaaacaaaatgaaacattgggggatatgttccattttgaatatagaactattttgagaattgtaggaaaatcattgtatatttagaattacacgtgtcctacaaaattgtcctcatacatttattcatccatttagcaaatcttttttaatatctgtcatgttaggtactcttctgtacacctgtgatacatcaataagcaaagctgacaaaattctttgcccttatactgcttctattctgggaacaggggctgtgaataaacaaataaaaaaagcctgtcatattgtggtcagattgtggtcagattatggtaagtgggccaagtgtggaaggaagtcagggagcatgccttgcagatacctgagggaggagcctctaaggggtagtgagatgggggtttatctggcaaggatgggagcagcttgcaggccatgcagcatagtgtggtgtggagtgaggggactggaagtagggcaggggccctaggtcattgtgaagacctttactttccatctgagtgggattgttatggactgaatgtttgtgcccacctccccaattcatatgttgaagttcaaatccccaatgtgatggtatttagagatagggccctttagaggtaattagatttagaggagatcatgaagatgggacctccttgatagcgtgagtgtttttataagaagaggaagtgactagagctctctctccactatttgagttcacagtgacaagggggccatctatctgcaagccaggaagcaggtcttcatctgaaaccaaatttgcctgtaccttgatcttggacttcccagcctccggaactgtgagaaataaatatgttgtgtaagccaccagtctaatggtgttttgttatggcagtccgagtagattattaaggataggagggcttcagcaagttctgaagagaggagtgagctgatctgacttctggttgaagaggatcactctggctgctatgctgcaagaggactgcaagggccaaagcagaggctggaagacctgctaggagacagttggagtaatcggtggcttgaattgaggtagcagcaatggaaatagaacacagtggtcagatgcaggatgtgctttgaaagtagagctgaatgtactggtggattggatatgagttattatggacagagagaggtcaaggataaatccagagaaactgtgaggatagagttgtctcagtggaggtggacacagctgggagtgaggtagaatgttgtgatgggaagatgaaaggatttgttaccggcacattaattttagaatacctattagactcctgagttggagatgccaaagacgtcattggatgtgagtctgaaatctggtagagagttcagggttgggaatataaaatcagaagttgacagcatgcaacaggaatgttatttaaaatatttgataaccagtatgacttgagaaccaaccaatcaaagcagatgcctgctttaaccacaggcatagctgtacagctcctgtcagcaggctatcagtccaatatgcacttgcatttgctaaaacatatcctttctacattggtcattctcaacctttacagataaactacaaattttatcaatataccataaatgcagattacccattaaaaccaaaaaaggcaccaactagaaagcataagcagggaatatttattttctccactattatatttgtccactccctaattcacattatgcccactgtattttcttgtaagggttaagtacaagtatttaacatactaacatatttgtgaaggccagggactagtttgaaagtaccagctttcaagtacaatggacttgtatttgagtcctggatactccattgtactgtttttgcagaaataagctccttttccttcctttttctgaaaataagtctgtaaagctggaaataagactacttcacattgttataaggattagaaattctatatataaaggatctattacagtgcccattaattgcagtacaatttcccacacaaattgtaggattttagagcttgaaaagaccttaacttggcttgtgttcttaataataactggtcaaattattataatatatcacacaatatatgttggatttaggctgtaagctacattcagaaatgcttgggcataaatatgtgcacacttggacaccctgtttaccaggaggaagtataagttcttatcaaaggaaagaatgattttgattatttctttctcataggtcagattgtaaaaacccagcaaaaagtgctttcgcatacagcattagcaatcaattatatctttatataaatatttgcctatgacaccaagtgacttgctaacccctcatttttgttgataacctctcataggacaaaaattacattgccgccttgctctgatatttcagggttgagctggtgtactattttgtgaagataattacaaggctaggtaatgcatattttaggtaaagagagtctggccttctaggcttccaaagatcctataagttcaagtccttggtacctctgtattctagacagatcttgggggaatgccttggctgcattcacagatagatagtaatgtaagttccatgaggttttgtttcatgactgtttatttacttttgattctccaatacctataaagtctcctggcacagaatcaatgcccaagaaatagatgtcaaattaatatgtagaaacaaaaacgctctagtgctaattctacctcaatgtcatatgcaattttgagggaagcagacactgaatgagtatcttatttctgtgaaagcagcttgtaattgatttacaaatgtcattccttggacctgtgactgccagcattggactctgtgtccttttatgctcaataatgctttttccctctcctcattaaattctggatttttcttacctacttttctctccctaccaaagaaatagataaaataccatgctcttcattttattggtgggtcagtattaattgcccaattctgtctttgctttgaaagaattcttgcctaagaggtctctctctccataaagtcgataccttttccagtttcccagacaagcctgaataaatatgtcagaacctagcagtggacagggctatgaatgattcaaaactgtctattccctacaacgtgtaaatgaaaatatagacagctgtacaggatcagaataggggagaaggaacagggaaacctggaaggctgctcttttgtgaacaacagcctggaaggttgggaaatgattttcagtgttttgtgggactgtactacagattggactatgccatctacttgtgctaaaaagcacaaaagtcttttaaaagcaaaggtgacaaaagtcttttaaaagcaagtaaagacattctccagaaatatttttaataaaacatgcacaataatgctgctttttccaactattgtgtggttgtaagtttttgaacctaattcttcaaattataacaactactaaagatttatcaaatgtaaatcctgtgccaggcatgatgctcaaccctctgatggattgtcttgtttagcagacacagctagcacattatattatgtacatttttacaaattgagggaaagaaggcagagatgctaagcactttgcccacagttacccagtaagtggctgagctggtactgcatgccaggtatcctgcttgtggagccaacagtcacttctgtactatctcagtgacagctatggaggcctgggattattttatttatcctattggaaatgacagttgtagcaatgactaaatatactgtgacattaattccccctggaagtgtaatttgattatgtttggtaaactgaatgagtgcctgatctctatgaatgcagcttttaattgatttacaaattacattatttggagcagtgactgctggtattggacttggtgtcctattgcactctttgttgctattgttttctttcctgcattgacgttgttttctgtattaagctgcctgaatcatgtcctttgaaaatattaatacctttttgaagaaaaccaaggaattgtggtaactccatggtgaggtagcctttgagtggaaataaccaaaaattacctgcagtgggaattaccttttggttattgtgcataaaaatggcagagatagataaatggataggtagataatgttttcttaaatttatttgtatacatagataatctcacagcccatgaagactcaacatataggccttttaatgcctacgtttagtttcctcgtattgatttacttgcaaattttctaatatattcttcagtagaatttactttatagctttatgtccagattatcttggcttttgcctttggataacaaaacaactattccttcatttgaagcagatagttaagaaaacaaattaccttttgaaaaccataaggctgactttatgcctaggaatagattatttctcagtcctagggaaatatgcattgaacattattttatgatgctttttagtactttgagattcagttcaagctgacaaggacctaagtattggatctgaaactcctcacattctgttctgtttctccctgaaagcacctgtcagtgtctatagactttgaaaccaagatttaacagggtaacatttactgactatattatgctacattatgtataatagtatgacaggacaatgacttacaggtcatatgaatattattagctctctctgcctcctttgatttttttcttttttttttttaaactgagctactgcactccagcctggcagagtatctctctatggggtatcacccaggctggagtgcaatagcacaatcaaataatacacacacacaggccgggcgtggtggctcacacctgtaatccaagcactttgggaggctgaggcaggtggatcacctgaggtcaggagttcgagaccagcctgaccaacataatgaaaccctgtttctactaaaattacaaaattagctgggagtggtggtgcatgcctgcgattccaactacttgggaggctgaggcaggagaatcgcttaaacccaggagacagaggttgcagtgagccaagattgtgccattgcactccagcctggacaagagcgaaactccatatcaaataataataataataatgataatacacacacatatagaatgagagggaatttatgagaagtttgatatttcattgttttggatttggagaatgtttccacttagatcaggaacctctctattcacatcatataggctttgattgtataataagtgatagcaagtattgttagcctgtaacttcttaagccaaagctcctgagggaggatcataaatacatatgcctatcattttcccaattctacataatactgtttcaactaaccaaagcaggcttgtatctacaatttcatcattggagtccctattctcttacattttccttcaaaactttcaagtgtatgtaaactctataaggacacattattttcaccatcatagtagtaaagcatgctcatcatccagaacacttgtttcttcacttagtgttgacgtgtatctactttctgaattaattttcaggttctgttgctaattgcaagcaggtttatggtgccacatttttaccactgcaccctgtgctcattgatctccctgaagctctagttcagttccaacctaatgaaaagcaaatagatgccaacgacaatagttacccagctaacattttggttttggtctgggtcatccttctgaggcgtatgacttgctgttttgtatgttggtgtgtagagaggagccgatgtgttccagaagccctacatctaatgggcaataactcacaaaatcactagctagcagattctcacagttaaagggcgaatgttcattgaatattggaaatgtcaactgcagcctgtctgggtgatgtttaaaattatcaatgtaccaccttcaacataataattccctacattttctttgctttattttttattttaatttttaaaaaatggagacgaggttttgccatgttgcccaggctggtctcaagctcctgggctcaagtggtcctcctgccttggcctccaaaggtgctaggattacaagcatgagccaccatattcagtctacaatctcagctgaaccattctctgctcacaaatagcactagtgataggagataagaagaggtgatttttgaatggcctaatgtaaaagaccatcacagactttagaataccaatttgtggctctggtttaaatgaatagatagcccctggactccattagtacaactgaggggctggattgtaattgttttctgaagtccctgtcacttctgaaattctgagatttgatttttttaatatgtcgtgatccatgatatgttacataaaatgctaatatgctagacaattggcatatccacagtatttgagtagactttctaaattcatgaaattacaacactctgagttatgtcttagcaacttagaagtcagaagtcaaatttctagtctttcttgcagccagtgtgcaggcatgtcactaggcttgtagacttgtcccatctaacagatgtttgccatacttcatttggggattcatcagtgtcagaaggcagattttgcacagactttccatttttctcagtgaatgtggtggtcgagggctgtggtttgaggagtcagcagtatatttaatttttgatatgaaagtgacattggtcctggtggcattggcagttgacatatattattggtattaattgcagcagatgtagcggcagctgtttttccatcaggctagttctgaagcttagtcttgggactttttttctggaaacttattcctgagccctcccaacaattctggaagctattcaatattggtttaataaatttcttagaattgatggcgtatacccaagtgtttgcagtcaacaatcctaagaaccctgactgaacaaatgtgcaagtgatttttctcaaagaccgcataaccccaggtctaataattcattaattttagtgagaatgaatgaatgaacaaagtagaaaactagccataaacatgcatttgcaaaacctctgatcaggtgtaaggaaacattcattgataatgtttctcaaggcatttttaaaaactattctattttatgctttgtcctccatgcccaaacaattcaactctgtataaacagttctcttcattgaaaataactacgcattcattttttgctacctaacaaatggatattgtagtatagtgatttgaattagatgtgaataggaagaaagataaaagtgaacctaagtaaaatgttgcatttatgtctgaattccctggtctctggattatatgagcctgattcatcatactgctaaattaaattgccattcttaatcaatatcctaaatctccactgaagagagtttttttttttaaacattgtgaattatacatcatttcctgtatgtaagtctgcccaaagttagagttgaaagctatcacaataaaataatagaatggagaatttgtttttcctccctttctattttttttttttttttaccaagaacataatccaattgacaagagtaaatttgtttgatatatattatcatccaaggaacttgagatgaaattttttttcactgctaagtcaattcactactagccatgaggccccaaactgagagaggtataacaaatactgttgtctagatgttttcaaactgtgcattatgaccctttaacgaccactaaatatagtgagataaatttcattaaatgtcagagtatattacatgtagtaagattaagtattgttttctgtaacttatgttttagttatgtatgtatatatattatttgtttatatatgcattgagtcactgtatggaatgtaatatttactgaaagttatttcttattttaaaaagtttaaaaaccagaaatttaccttttgtcagttaatgccatgtttccttaaaaaagtatttaaaaaaatttgagtctatttttgattttcaaaattgactatggcaaaaatggttgctcagaaattgttattaccttagcttcttggagtttctgatacaaatttgtttgttcagatgatttaattacattagtagtttctaaaaggttttccgaggctctgtccaatgggtagttctgttcagcctgatacttagcacagtttcttcctcattattctttgtgtttaatgaattatataattgagggaatatgctgcagataaaaatcattagtcccttaattccagtgcactgctgagttatatatatatatatattttactgcttaggtattttgttcaattctagaaataaatattatttacgttggtggaaatgttcttccaactgagcttggcattgttggtgcagtttggctttgtattactggcaacttgaagcaagaggaccaggtacagcagctctttttcttgttcacagattgttcagccaaaccttcaacttagttcaaaagcatttttgtttaggagatattaaaaatagaaacttttccaaaatgatactgatatcattttattttctatgattttattgtccttaaaagaaggaaaaaaaattacctttaccatcaacagggcattcttttcatttttcattacataatacaagactttcttttatacccgttttatttacgtgcatcatcttcagagagctgtttttgccagggagccccaaatatgtcatgaaatgatgaataattttaatgcccagaggctttgtaccaggaaagataagtcctttgagaggatcagagagtatgatagataacaaaatcacttcaaacttcactgtttcacggcaggaatccagaagaaaggtcacccagacttctgattttactgcgcatttttaaatataattttcacattaatgttaattatagcttatattaatattaaagattgctttttaaaattaacaaggctatatttcttattccttttctatttcttttttatttcctttcctgaatggaagccaatcttctagtaggttataaactgtagtgtaatttgctaatgtagtctctaacacagtgtcataatttgtagatactcttttagtagtgtttataattcatgcaatattaaatatttagaaaggtcgtatctacaaaatgcaaacttataaagtagattgattaggtggtaattgatttattaaaaatttcatgaatggttaaccacatagatttgatttcctcatctacagttaagtgtgtttattaatcaacagttatcttgatagtagttctaaagagcagataaatataattaaagggctaagagccatgatcagttgataagaaataaatacagttgatcttcattatttgtggtttctgtaactgcaagtttgcctgctcttggaaaatttatttgtaatcccatctgtacttgaagccctttggtggtcactcgtggaccttcacagacatgcagagcagcaagatgtttgagtcacattgtgtgcatgtgtgtacccagctaaggtctaataaggccccactttgccttcttgtttaagcttttataaacactaagcaaatgcccttttcaccatctatgtaatgccatgttttggtgcttttccttgctaattttcctgtttaaaatggtccccaaatataaagctgcagtgctgtctagagttcctaagctcaagaaggttgtgatgtgccttatggaaaatatctgtgtgttagataagcttcattcatgcatgagttgtaatgccttttactgtgggttcaatgtcaatgaatcaacaatgtgtatcagttaagatctctttaaacagaaacacacataaaactaggttatatattgattagttgacagaaatgttgtgactaggggcttgcaggaaactaaccctgtatttcccccaggaacagtggtttagtatattgctcattcaatgttcatgatgattttatagaacataactactgcagataataagaatcacctgtattaagaagtccaaaatttattacagtgaaatgtaatggaaaaatgatataaattgaaagaatcaaattaaccttcacttatagaggaacacgtttctatatagagatgcaaccatccattaatggcattaataggataatatcattattttcaaatgtattttttctctgctttttttcacttcaaagagagcatcataggacagtcaatgattaaagggaaataataagaattttacatgtaataatttgctgctttattcatgtataaaacaagcctatttttaaaaaacatttttacaaatctctatgaaaaatcttaattcttcatttgtatagtgaataaaagtgaacctaagtaaaatgttgaatttgtgtctgaattccctggtctctggattatatgagcctgattcatcataccgcgaaattaaattgcccttcttaaccaatatcctaaatctccactgaagagagttttttttaaaacattgtgaattatacatcatcattacgagaaatgttgtttaaagttagatgctggtggattgttccagttgaagaaaacagctgagtcccatctaactgaacccttctatttgcctgcaaggaatggaggtccagatccgctgtctactttgccaagattggagagcaagctattggtagtcagggcctgaaccaacacttcctgatccagtcaagtgcttctattcttccttgggctatccattctctgaaaccctattgtcccacatggtaaaataactgcctagtatgaaaggatttatttcatgtaatatttattcataacaaatgtatcaactttatttaatgcagaatttaaaacaaatgtttaataacaatttcctttaatgtaatttaataataacaatagtacacaacattcatgcagctttagagctcttgctctcaaacacaacatgtaatgttctgatacctagttttaaagtggtatattcaggtaggccaagagtagatttcatccactaaagaatgaatttgtttttcttgatttctccgttagatgatacatttggcatttccaatttacttccatcttttcaacctgttacacctccatcttcatatattccagtataccagttactgaggacattgacatcattcattactcctctcctctcacatcccactctctcagcagttcctgtctgctctactttcaaaatgtattcagaatctgatctcattgtacctttggtgtcaccaccctggtttgaaactctgttatcttttacctgacttttttttttttttgagatgatatctcactctgtcacccaggctggggtgcagtggtgcaatcttggctcactacaacctccacctcctgggttcaagcgattctcccaccttagcctctagagtggctgggattacatcacctgactttttacatgcatgtttctgtgtttctacctttgcttccttacagtgtattttcaacacgtcagtcacggatgtgttcttaaaacaagcagagcatatcaccctctcctcagaactctacagtgaattcccatctagctcagaggaagggccaaagcctttaataatggcatactccaaggctctgtataacccctcatactcacacccccgatactcacacctctgatctcatcttctactgccttctcccctgttcactcttctacagacacactgtttctcaaactggtcaagtaaagtcttgctataggatctttgtatttgcttttgtctatcttccatatggtcttccctgaggcatctccatggcttacactattcatttccttctggtctctccttaaaattcaccttatcagtgatgcttttcccaaataccctttctttcccttcttctggtactcacttccctcttaccctgctttattgtttttcagaacacttatcaatttcctatgtatatatttacatatttgcttaatattgatcagtcttctcatatttgcacataaactttgtgagctcaggcacgttattttgtttcatgctttattcttagtacctataatattttgcccagtgtaggaactcaataaatattcactggaagaataaggaatttatcaccaatgactatttattgagtgcctgctccctgtcttcaacattccatgaattaaagaagtatgtacatgtaactagaagataagtctgatcctgctgctacctcctgtatctgctccattgatcaccagacatctggctgactaggcaggtggtctcttccaactgattccatgtgcttggtcagaaagaagagaagactttgcttctatcaaggacatacacaaaacttcagaacaatgcaaggttggataactattattgtagctaaaaggatgttaaattttgtataaagttgaaagtcagctttctctgcaattcttatggtgcctatttgttgattataggttaccatgtgtctaaagtttggactttccatttattttctaattacaaaattatgggcttatcattcaccagagatgatttggtttaagacactgactcagcctaaaacaacccactgatacaccaatccatttattccttcaacgcagtttcttatgtatgccagaatatactagccacagtaaatacagagaccagaaatacaccaccagattttgcagactacagttccttttagggtactactgtgtttactgctcacgtgttgtctcacttgtatgaaagttcacataagaaggcaagttaagaacagaaagttacttaatatatataaagtcagagcaaaggaatatgcccaccgttcctgccaagtgagcaagaatgttcattgtaactgattaaggcatgtaagtacaacagcaaatacttattttccatttgtctatttttttgccaattagcaaaaatattatcttataccaagcatgttataaggtgattgaaaagattcaagtttgcttgcttattttttgtagaagttatattcaagacatctttccatggtacatcttggctgtggatggaaatttgacatactttttattttctttacctgttacatatcaaatcttaggatgtattacttccaaggcggttaaacttattcaagattgactgagtctcctattttccttaaatttactagaagtgaggctccaagaactacagaaaatagaaggaaagtctccattgagccatgaactgtgagcacctggcatttaagcatgaagagtagggcttctatggtagggactggagtaggcagcattccaggaaaggatctcagaggtcagaaacaatagattatcagttaaatacttctggaccaaagaagaccttgaaatcctggctcggtgatgtatacatatttaatacacaatgagaagctccttgagggtgagtgagagtgatagggctgaagaacaggagacagaagacaattcaaatgtccttacacagaagactgattatatagataatggtacattcatataacatgatatatttactaattaaaacataacacacacacacacacacacacacagtcactgcataacaatgtttagttaacaacagactgcctgcattgatgatggtcagataataccatatttttactgttatcttttctatgctcagataagcagatgctaaccattatgttaacagttgttgcttattcagtacagtaacatactgtgcaggtttgtggcctaggagaaatacactaccatataggctaggtgtgtagtaggctataccatctaggtctgtataagtacactttgatgtttgcacaacagtaccacctaacaacacttctcagcatgtatctctgtagttaagtgacacatgctataagtgtttgtgtctgtgtgggtgtgtgtgtgtgtgtgtgtatatacacatcatgatagatcattgatcatcattaatctgtagtcattattacttatttacaaaatactttatattttattttttataaaatacttatcacagaatactttactaatgagagaactagcaagatgccaaagccagttcaaaaaagtgtaggagtaacagaaatatgcatagtcactgaaaaaaagaatgctaggatgtaattgccataaaactaaactggttattgctttacaggcaacaagggtataacctttgagaatcattttcagcatcatcagttttcttaatccagaagttggcaaactttttttgtaaaggagtaaattttttaggctttgtgggccatgtaagttctctgttacgtatccttatgctcatggactatataaaaacactctcctatcccaagttggcccacagaccatggtttgcagactcctgattaaagcctaatcaatagcaaataaaacaaaataaagatacctattctagagaattagataatcctcaggtgagtcagttaaacagtgtttcatcatgtcattcaatggacatgtgttcttttggccatttgcaggttttgaatatggagatacatatttatatatttttgaggcagggtttcattgtcacccaggttggagcgcagtggtgcaaacatggctcactgtagccttgagctcctgagctcaaacaatcttccttcttcagcctcccatgtagctgaaaccaaaggcatgcaacaccacgtccagcttttaaaaaatgttttgtagagatggggcgtcactttgtggcccgggctggtctcgaactcctgggctcaagcgatacttctgccttagcctcccaaagcattgggatcgcaggcataagccactgtgcccagctatattatttttttcctaacaaagatgcctgctggagggagctggaggggaaacagtgagggagaatgtgaaggaatttgaagaggtagggccttgtgggtgggatagccacactaacctcttttctaggggctgtcctggtttactggtataaaaattaatcactctcttttcactctcagagtgtcccagtttggatgatacatgataaatgggtcacgttaagaagtttgctcctcaacataaaattaataggaagggttgacaaattttaaactagtcaagtgtgatataatcagatttgcattttgaaaggatgactgccttgttggtaatggatttgaggcaaagacacaggggatgttaaatggttgtttaccaggaaatttgtctttcaggttaaacaatttgttaaactttctcaatagcaagttaattttgaaaaaaaagaaaaatcagaaaagtatgttgtttgatttaatgagtttgtcagtggataaagactgttgatttagtagccccatatagatgaagacatttcgtagttcatttagttaaaacctatgacttgttagatttgtttgccacatagttatattgtgttcttgtgcttccctgggcgtggataatgagaagactgtaaaatgaaacatgctttatgggatatgccttagctgcaaagccaataatccagaatgcagaattacaaaattagtgagaggattttgtcttaatgactgtatgagtgctgagatcaccattccttgatttgttcacagttatatccccagcaaatagcattcaagaaaatttgctgagtgactgaaagaatgaaccctcccagaaccttatttcttataatactgtgctctgtcttcttaaaaatcttaggtacaactattcatgaagctactcatttatcccattggcttagaatctctgaatgaagactctagtcaagaatatagacgtaaatatattttccaagaatcttggaacatattttctattaatgtttttttgttcagggttgaaggacagtttgacaaaatagtttgcttaagaatagaggtggcaaaaccaattttcatcagaaaaagaattaatgtcatatgggtgtttttattgagaacatttaaaatgtatcttctttattcattttttacagtatttcatctggcatataagaactaggaagaaaacttaattaaaatgcatattcagaccaagtatgaagatatagtatctttatataatgagtgaataaaatcagagtaactattgattgttctctaaataattcagatgctataaatacaggacatatgcataaacacttaaaatcacaagccaagacaacgtagtgagacctcgtctctacaaaaacaaaaaattatccaggtgtggtggtgtgtgcctctagtaactggaaggctgagatgggaagatgacttgagcccaggagttggagtctgcagtgagccttgaccacaccactgcactccagcctgggtaacagagcaagactctgtctccaaaaaataaaaaatatgtaaaatcacaatcacactttaataagatttagaacctttggaaatataatagtaataaaataccaaaaattatatttcttaaatttggttcttaaaaatataatttacttaaaaatatcgctcatagaagtgtgtggtggcttacgcctgtaatcccagcactttgggaggccagggcaggcagatcacaaggtcaagagatcgagactatcctggctaacatggtgaaatcctgtctctactaaaaatacaaaaattagctgggcatgtaggtgcacgcctgtagtcccagctactcaggaggctgaggcaggagaattgcttgaacctgggaggcggaggttgcagtgagtcaagatcatgccagggcactccagcctggtgacagagtgagactctgtctcaaaaaaaaaaaaaaactcttgtaaaaaaataagaaagtttaccaagtttgaatcttaagcaatttgaataactgtttggttaatgcctagactgtgagaaagttgccaacttttcacacttttcattagttttctttttccctttaattgtacaataataagtctagtatcataatatttgcaaactgccccctgttctctaataatctctgttcatttattgttgtgctgactgcagtctgactctcgagtgagctgctttatctgcagcacctggaggtgttggctgttttcttgggcctctacacaccacagaaccaagggatggacagatgttttctcgctcttcactgcttttataagaccatagttaacacctcctccttcaatatcccctacctccatccttacccaaccctatctttgagaaacacatttttagattataacatcctacattcttagtgcagcagttttctatcattctcttggtgattcccatcatttgttgtattatatagtaactgacttactacgttctctcctttccacttctgccatcattcttcatggctttacttagccacatagattatgcatgccaaactccggcctctcagcacctatattctctctttcagcaatcttaccctctactccagcggtcaacagactttttctgtaaaggggtttgtattttcagttttctggacatgtcttagttgcaattattaaacaatgaaatcctagctttataccaacatggataatacgtaaacaaattgatgtggctatgttccaaaaaaaaatctgtatttacaaaaatgaatactctgaaaagctgcttagggacttaaaacagatgaggccatgagccatgtgaatatcggggaaataattccaggcagaggaaacatcaagtgcaaaggctctgagacaggagcttgcctggagttctccagaagcagcaaggatgccaatgaagttggagtgcaatgggccagggatgagtagtaggagaggttagggggataatgagggtggagcgagggaccttttaggccatgaatggaatttgggctcttactcagagacagtaagtggagagccattggaggattctgaacctaaggacaataatcagatttaagttttaacaggattgttctggctgctgtggtaaagacagtgagagggcagggtagaaacacagaaatgagataggaggctactggacttgccatagatcaggcttgtaacagtagaggagatgaaaagtggtcagattttctatatatgtatgtatattccatctcaccctattatatttagaaggatttgctttcagattagattttgctttcacagaaagggtcaagaattaccttggggtttttatgagcaactggaaagatggaagaccatggatgaagcaggttttagggggacgatcacgagttctttgagcttgtttggtttgagatgtctatgagataagtgaaacaagcaaatgcaccacacgtttgagatgtctgacattcattataacttccttgatttcatgataaatagataattattctttactttagaaacatcattgacctaggctgaactaactgttctctcgaaggcttagataaaaatatattaggtgcctgatagatgcagactggtgcctgcagctatatttactagtattcttcattattcccatggcatctaattcatgagcaagttcataaataactcccatgtttttcccagattgtgagcctaagattacagaatgtatttttcatgtacttcttttgcatgtattatccaggagaaataaactgatattttaagtgctttcatcataaaaatagatatatagaggcaaatgttattggataatataatattatagtacaatatgtctacaagccagttatattgcatttcttaacatgtattaggattttaaactcacagatttcctgcttataggacatatcaactttggaaaaatgcaataaatgaattttcaaaaaaggaattgaaagatgagagcatttgggctaatgagtctctagggaaaatacagttgcaagtgttaagataatatggtagtaagttacaaagagaagatgatctaataagattttccatttactattctccaggggctagtgttataaaagcagctcatctgctcggttaattttttgaagagcatatttttggtttggcaagataaatgttctatgttttctctctagttattcattaaaaacaattccaaaataaaatgaagtatgttttaaactttaactcgagagtgttgaagagagaaaactcttacacttagagaatcatattcagctttgtattggtaattactgtattgtttatttcctatactatttattagccatattcatccaggaatgtagaaatgtaaaaacttagaaaggatcttataggatcttcttaaaggatcatctaatccagtgcttatcaagtattacttactgtgagctagagtataaaaaatgttttatatcatggcccagtgtatattttatatatatatatgtgtgtgtgtctgtgtgttgtgtgagtgtgtgtgtatgacccaagcaaaagtttcacaaagcaatagttacctttaatgtgaaatatacttcaccatgtttgattttattcttgttattttttatctcctttaaaaattgtttcttctagccaggaatggtggtgtttgtgtaatcccagctattctggaggctgaggtaggaggattgcttgaaccaggcattcaagaggccagcctcagcaacatagcaagaccccatttcaaattaagaacaaaaaaaattgttctgtttttccttacagaagtaacaactcttcatcagcaagggatgtgccttctcaggaatacctttgcttttcccatatattgtctgtcttcccttacttctcccataatcatcaaaatttctgataaggttcagagagtacagtaagatagaccacgacagatgtctctcttcttttttgatttttttttttttttaagacagggtatcactctgttgctcagtctggagtacagtggcgatttctcagctcaccacaacctccgctgccctggttcaagcgattctcctgcctcagcctcatgagtagctaggactacaggcatgggtgaccacacccagctaattttttgtaatagagacagggtctcaccatgttgcccaggctggtctcaaactcctgacctcaagtgatctgcctgcctcagcctcccaaaatactgggattacaggcgtaagtcaccgcacccagcccttttttaatattcctaatggctaaggatattgatgagagatcactgactaacttgcaatacatagtggaagatagaataacaaaaacataaggcaagaagaaaggaaagttggaatcaccaatcaaaattcataaaacaaatgatattaatgcaaaatttaaagagggaaggaagatttttctatataaatgactattgtttcaatactcttgaaatgagtatcaacttttccaagaaatgaaattacctttttagaaaacaaaataagcagaatggaattattcaattaaaatatacaacaggataatctcaaattatttttcaaagaaaacaaagaatgtttccagatattactaaatctattatttactttacccttaaatttatgtttttattaaaaatgagcaggacagagtattacatgaattacctatttacttttatattgttttagtcttctctgagcttctatatttagccattgatgacgtttttctttcaagcaaaagaactgattgttctttcatgctgtttgtagtgtcatgtgatagatgtggctgatacccatacagtcaacagttactgatcatatctcccactttctaatttcttcccaggttgaaattctcccaggtaataactattttgacccatcagaaacccagttggattatctaggcttctaattagtgctggcttataaaaggcataatgatttcttctagtcagtactgaatgctattatactaatctgatcctgtagatattgaagataatctaaacttggcttttaatcttgaatcaggagtggggtgaggatttgggaataaggatggagaccatagtcaccagagttgatatgctttgaccttcaggacttatcttgggatccagtaactttctttgtgtacttttagaatagtttttaaagtaatatggatggcattccctatgaagttttcatataataattacatttgattattttaaaaagttaattttcattcctattaagtgtaagcagtcaattgctttgaaatataatttaattttagttgatattaagtttacaaggtagattttttgtcattacaggaagaatatctgaaattttactataatttttcaatttctgatatagaaattaattttaacttttgagtgatgaataattacttatttggcatttataaatggggcatattgctaaatagtttttcaaaaatacatatcccttatgtaactttatgtgttcaaatagctaaaattagaacagattgtggcttctaagcctgaccacttcatttgtttgccttagccagctaatcaaactcccaattttttatgctcaaatgttaaagtttcatgttaaaacaagtaaaaaaagacaaagtataaatgctatgtaggactcttgaccttaataacaacataaaaattaatatgtatctatacctgtctatatttctattcagtgttttaaaaatgaacatctctatttcaaaaaaacagcatatattttttctaatgtactcaagttaatatattttatactgggaaaatgaaaatcaaatggtgtcattttattaactgtattacttgtgttataggaaatactttttaaaaaaccacatagagagatttggcttcacttttctagaagtgttagtttgattttgaacttagttttcagtgcttttgtgttttctatttgaaaagttttctctctagaagtgagcagctttgtcataaataaagccaggagaataatggttgagctgaaatttctctccagagagtgtaatttgactgttaaaatgttctaatactagtgtgtgtgtttttacatttttaatgtaatattgaaaaaagtgtatgtagatataaaattaatacatatatgtatatatttattatttttaatttacaaatgaacttaatgttggcttccctcttttggggtagacttggcgtgttagatggcctaacttggctagtgcttgttttagctatgaattataattaactactgatgggaatataaaaaggatctgacttacaagctgccatttttgcatcccagtatgtgaaccaaatccaactacctcaatctttgaaacacagcaaagctaaaaatgcaaattctgcctcattaataaccaggactattactcagagctgacaaacaatgattatgaggatataatacaatctgttctgtatgaattactctattagtatcatgataatattggcagcattgccctaccatgctcagttttagaatttttactaattctttcttactttctgaggtcagactcattctttttttctgctaaatttgcttatgatattgaaaaacgtatttgaggacaatgtggtcaatcacacatttcagattaagtcttttctgtttatttatctattgttaggtaacaatccccatcccagatttaatggcttaaaataacatcagtttattatttgtgataattctatgagttgactggattcagtcagttgggtgctctactgtagctgaggtcattcatgcagtttcgttcagctatgacctctgctagtaatagaatgtcagaattatctcttatcctcagaggtttctcttcatgtggcctcttgtcttccaatcgaacctgatcttttcttttagcacagcaagtggtttccaagattacagctccaatgtagaaaacatattaaggttttgcttgcatcacacatgctactcactcaaagcaaatcacatagccaagcccagaggtaatgtgggaggggactgcacaaggacatgaataatgatagacatagtccactggggtccaccaatgtaattgactgcctcctctccataataaattttagtgaagaggaacagatagtgagtttgggttgtatggcagagtaagaatcagtataatttgaaccaaataatattttatataaataatttcataaaattataattaacaaccttggttttattttgtgtggggggtactgttaagaaatggaggaggaaagaagtagtactgaaatagaaaacattgactttgtatcctgtcagccttttaggaaagatattaagtctcaataaaataatatattccttttcttttgacagaagtgtttctaacatgtgtcatcaaaatggataaggtgtacctaatcactgttgacacagtttctacttggagtttaattttcctactcttttccctcttctcccttgcccattcatttccacttcctctctctctctctcgctcgctctctctcgcacacacacacatacacacctttttgtccatgttatcataatgtccatgatgtgaaagttaatttttggaaatgaaaatgatttaaatttatgatattttgtatgttgggtaagctttcagattcttcaacttgctagcatttttggtacattaaatgttctatcagataaaatagctgagtcactggcaattctcatattcttaatttgaagtggaaaaataacaattttctggggctttaggaactgtatagagagacaaatgtggctttgtatcctagacatcatctagctacctctgtaccctcaaaattatagcatcacattttaaacctacagtcaaaatggttttctttttctgtggaaattgtctgttacgtacttgttactacttttctttctctagtcaccataataatttttttatttcttctcttttgaattttttttgaatattattttaccctgacaaaccagttcatatcccaccaggtatttggcaagtagtttgttcacagaaaggtttcagggagcccacgtagtattctcagtaagaacaaggtctttggaatcatccaactctacattttggtcctagccaggccaattacttgctgttaacctggaagtttcctccatacctctaagcctgtgaacattcatttgtaaaagcttatggcaaaatgtccttgtggtgcttgcatatattaaataatataactcttgcaaaaattatttgcattgtgcctgacagtaagaacataagttttattatatcttttaaccccttaagtgaaatgaggaattaaatagaaaacttctatcatatttaattaaaatttctcagatcatacaaggaccatggtctatttgaccccttctttatggagctaatatttagctagaaactgcaatggaataatgcaagaacacagaacaggaagagaaagcagcgatcctgcaatcattcaaatgtgataatacatgcaggagagaaaggaaaagaattaggccatgggtcagctaacctttggaactatttttagcctcagaagcacttttatcccccttataaattccatacttaaagttccagaatttaaaatttgatgagaactgttgtgctgtttcaggttgtgaaaattcatttattcatacacgtaattttacctttgagcaaacttcaaaaagaatgactgccaaaatgtattataacctgttttctcaaatgtttttctcattctcttttttaaaatttctctctaaaaacgtcatagggacaactgtaattaggctaattgcgtccactcatatgtgcagcttatggcaataacagagcagtcatagaaagaacgaggtgcagtatgcttcaaaatgcagcatctgcagtgctgtcaaggccagccatgccgtcagtcttgagctaacagctgtgatgaacagaatgttgtgttattcctttggtgtgaaaatgaattgacagttatttatagggaataattaatgtaacattttgtaaaagtaaacatgattttcaatccttgagaaactgttaaaaaggaaaaaaagaataggaaatgaaggatacttttgaccaacagaaaaggcttgaagagaaatagatgatgtctacaactaaaacactatcttccagaccgtttagacataccatcaactctgagaataatagttgaagagttaaacatttttaaaggaaacaaacccatcctcacagtaattgtgaacatgtggaatgtctctgtgaagactatagtatctacttttgttaatatagtaagtaaaaatcatgacaatttcttataattctgttttttcagttcattatttaaaataagagagtggaaggaagtagggtgggacataggaaggaaggaataaaggaaggaaggaaatatgtatatattaatcccaagtaaatatgatgctgaatatgtgatatgaataacacatttattcataatctcgcatggtcaaatggctggttagacatattagagattattttggaattgtgtgatgcaaaagaagtaaacttggctgaatgatttgtctcaaacccttatcacatgttagctggttaagtgcttttgtatcatgtgtttgattatcatgtttccatctgaacagtaactcctgacttgttcaaaaaataattgatttctgaatgatgatatttagtattaattagtattaataagtgaatggaaataattttaagaaaatgttattcccaggatagacagaaattattgctacttctccagttgtacctgaaatattctcctctgttcagctgtatacctcttcgatctggacacctgagatcccacctgcacctaaggcttttaccttcagacagtggaagaaagtaatggtgatttcctcctggtcagattgtagactttacttttcagtttaactttgataacatgggaacccatcttattttccagaataattgttatgagttctttaagaagccatgccattatttaagttcatttgaatacatactgtattatagctgctaagtgagatatctctgaaactgtgtcattcaagaagccagtgagctatcatccatggcccagctttctttattgtactaaatgatcattagaagatgcaccatcaaaccaaactctttatattcttcagcagcataagtttaagcaaggctagcaggcatctctgatattggcaacgtgaagaatacctttcacaccattaaagtgatggaagaattgcttatgtagccatcttcttattttatttatatacattgtgtgtgtgtgtgtgtgtgtgtgtgtgtgttatgtgtatatataacatatatatagctatctttggtgaaaatttccatcccaaaaccttctatagtaaatgctcaaaaacaatttgatgaaagaccatctactatgtgccagatctctgtgtgggatgcaagacttataaaatatggttcctgttgggcagtattggtgacgagactatatactgaagaagggaaaggtattaaaggtagtaaataaagataaaatatgctgcatgaatgacctcaagggtggcactgtgacaagtaagataagcgtggcagggcagcggggactgcagtgtgcttacatttcatgcactcaagagctaagtagagggtctgagactgaactgttggctgcattcccagtcacctacagtataggcctcctcctcatgttaataacaatagaaaattcatattttacaaactataatctatctagagagggattcagaaaatattttaataggaggccaggaatgagatccaaaggggatggaattagatgataaagcacagagattatgttaagtctatgagcctgggcattgaatgagtactacagtctccttgtataaataattttagtttgtgtgataacctgaatgttcttataaattcacattttccatgtggtggtcatcagtgcatgggaaacataacaggttgtagtagaaaatcattattattttgtggtgacttttgtaaaagcagttgtgtcctaaaactttgttgctttccctgccttcttttgctcccagtgaagatcaagccaccacttcaagtgatttggatacacaggaagaattcactggggctaccagaggttggaaggtgggaaaagggagaggagcagaaagaataactattgggtactaggcttggtacctgggggacaaaataatctgtacatcaacccccgtgacatgagtttacttatgtggcagacctgcacatgtacacctgaagctaaaataaaagtaaaaaataaaaataaataagcaaaaaaaaaaagaattcactctctatgaaggataactgggacaaggtgtggggcttatgaacaagtaaatagcagatacagcggtttgtagttctacatgtgtgatttagtttagagttatcagttaaagtctggctcattgaaaattttaaagtggcattaatttgagaaactagtaaattattttagcaaaagttcaagctgtacattttgggctaatgacttggtaaatggatttgggtgacctgagtaaataagtaacataacaaaaactgtgttttgccaggttggccagggagtgccacctagaacttcttggacaaaagggagaacacagggaaaccatttcctagacttggaatcattcctcttactgtctgttgtagtgaccaagcatgagttggtgaagacttggactaaggtgatagcaaagagagtggcaaggaagtgaaagaattgccagaacctggtaactttgagtatatggatatatattataatgatccttaacatttgtttagtattcacctcaaaatttgtggatttttatctcatttaatctcaaccattttataaagcataggtactaatatcattacaagttaagcagtttttttttaagatcacatagttaccagttttcagaaccagtacccaaaccttagttctatctgaactcaagctatgttgtaaaagatacggacgtatcaaaggctaaaataaaatgtaatgccaacatttctagctaggagacatatgtccatgtgaagtggggtttaacgttgatcgttggaataggtataacacaatttttcttctcttatttttttctagtgcgacttcatgatagcatatcagaagagggctttcactacttggtgtttgatttgtaagtatatactctgtattcattatttttgcaatctaattgaggaccgttttgaattaatgatttttctcactgtacagtccaaattactgactgctacaatattttttaatgttcaagtaacattcaactctaattcttttgaaaagaggatactactcagcattgttttatttacaatttaatttaaccttaatttgaattaaccttaacctaagtgaaatagttatttctctttgcattgtccgttgtgatgtcatgagtggttctcaattctaccttgtagcacaaaaatgtttgacataagcaaaattttccatttaatttttaagagtatgtataatttattatcttaaagtaaaaagaagactcaaggaagaaacttggattaccaaaattgatttaaactaatcaagacttttaaagtgaggcgctgtcagcaagaatgaagggaaaataatgactcttggcagggatatagtggcagggatatagtaaaacaggccacacatatggttggtaggagtttaataagaacatactttctggaaatcaatttggtgctactgtgctcatcaaagggaataaaaaatgtttgtatcatttgacttagtaattttactcctcagaacaaagtccatggaaagtataccctaaattcagttaaaattttatgctgaaagatgttcattgcatcatcctttataacgggggagaaaagaaaagaaagaaaccaacttaaggatccaattatagagaaatagctacataattatagtatattcatataatggactactgcctagcattttaatttgatgccacagagttttgggaaagatttaaaaaattatttcacatgatatgagtttgaaggtaggttaatactaggtttggttaattcagtacttcaatgatatcattaagaaaccacgttctttccatctgtctgtttttagtattatgtgggtttgtcttcatgtttgagttcccctatggtctgaaattgactaccacattttcagttatcacagtgacttccaaaggcagaaaaagggtaatccaaattctattgcataagtttttattcatggagaagtctttctcaagagcctctcagaagatatctgttcaagattccttaattagaactgcttctcaagcccacactaaaccaggtatttgttaagggaatgaaattacaactggcattgacaaataataatttagtctgtagatctggtgagggaactggcctcttaatcatgtgatacccagttcagaactaaattgtgattttgttattaagaaagaatgggagttttatctgttgggtagtgtcatgcgcatccatgtgaagagaccaccaaacaggctttgtgtgagcagtaacgctttttagtcacctgggtgcaggtggactgagtccaaaaaaggagtcagcaaagggagataggggtgggacagttttataggatttgggtgggtagtggaaaattacagtcaaaggggatttttctcttgcgggcggggacagggattacagggtgctcggtggggagcttctgatactcattgtccaggagaaggaatgtcacagggtcaattgatcggttacggtggggcaggaacaaatcacaatggtggaatgtcatcagtcaaggcaggacctggctattttcacctctcctgcggttcctcagttgctccagaccatcttaatgcgtacctgcaggcttgggctcagaggcctgacaggtaggcagccaagcatatctgccatatttagaatagagactaaagcgctacttctgcacaatcctactgcacaggctcctctccacagtcccagttcatccatgtcttgctcatgtggccgtagtttcatctggctctatgttgttctagtagtgcttcctcttcagtcctttctcagctcttgtttttactttttccattattttttcttcctttccaatgtttgagtcccttcttttatgatttttttttcttgagctttctttagccattcttttaggataggtatgctagcaacaaattgttagtattcctttttctgagcttgtctcgatttcccctttattcctgaatgatatttttgccagatatagaatccaggttgagagttctttcaatgttgtgccacttccttctggattccttgatttttgatgagacatctttgtcattctaattgtttttcccctaaagataaggtattagttctctctggctgctttaaaattttttggtttttgtttctttttctcgttgtctttggtttttaggtttgtctatgatgtatcttgcttggcttggattttttggagtttacttatttggagctcacttagcctcctgaatgggtccatctttgtttggcaaacctgggaaacttttggacattgtttctttgaatacctttttagccctaccttctttctcccttccttttggaactctgatgacatgagtgttggatcttttgttagagtctaagaggtccctgaggctctgtttgttgtagttttcccgtagtctgttgtctttctgttgtttagtttgggtaatttattattgttctgtcttcaagtctgattgtctaattctttcctctgttgtttttttttttttctgagacagagtctcactctgtcacccaggctggagtgcagtggtgcgattcaggcttgagtgcagtggcgcgatctctgctcactgcaaccgccgcctcctgggttcaagcgattctcctgcatcagcctcctgagtagctgggattacaggcgcgcgccaccatgccggctaatttttttgtatttttagtagagacggggtttcaccatgttggtcaggctggtctccaactcctgacctcgtgatctgcctgcctctgcctccctaagtgctgggattacaggcatgagccactgtgcctggcccatccattgagttttttatgtcagttatatttttcatttctgcagtttccttttcttctttatagcctctatttctttgccaagattcccttttgtttgtttgtttcaagtgtgttcataagtgctctctgaagcatttttttattatggctgattaaaaatccgtatcagataattctgacagcattgttatcttggtgttgctgcctgttgattatcttctcattcaaattgagattttcctggttcttgatatgatgagtgatttttggattatatcctgaacatttgggggtattattttataagactttggatttcactaactgttctttagcaggccttctctcataccagagtaagcaggtgccatcttattactgactgatgggggctgtagtccaggttccccccacagcctccaccgacatgcctgggtggtggttccttatggctaggtgaggttattggaacgcagggatttttattttttctatatttactgggagcaatacacctaccatattttttaagcagcagacatgttatttcttaatacatttaatttgtcagatctttgttttgcagatcaaggtatggtattgtaaactgagatatgtccttcatgctatgatgaatggtggaataaaaaacacttttgtgagttctcattacttaagtaataacattctgaagtgagtttgatcacagcttggtcagggaggaaacacttttttctgtccttttaggttcagtgcctggggcatgagaattaaacaagagagagattaacaagagacaaggcatataatttgtattaatatttatgtgcatgggagttcacagaaaagaagtgaaactcaaagaagcagttaggctcaggcttttatacccttaaaagaatttgggcttcaagagataatggagaattgacttatggaaaagtgactagtaaatatatgaaggagctaatggaagataagggctattttagtaagatctgtttctgcaaactcatctgctgtcgactccctgtcttctgtgatgagtcaatctttctcactggtgttggggaaagagagcatcttccttaaagggaaatttattccctgcttttaggcagataagggagggcagataattctctctatatctgttgattctcacttagctttagctcaaaataatccttatgccaaagtggcatatttgggcgtgatatattttgatctccttctgctgcaagaagcacttcagtgttaggtcaaaaccttctactatgccagttttccacagtcatcaaattatttatatctatattttaaaatttatagcttctgtattccttattaaattaagggcatgatgagaatcacacagtttattttttcttgtatcattttttagaaattcagcataatatttggtgaagaacataaagaaagcagttcacatggaaacagaataagatttttaactaaagtggattatgtctttagcaatggtatttgtttgggttattaatgtctttgaaaccaaagtgaagaaggtaaaagtttacatacaaaccatagtaatttgaaatatgctgcaacaggcaactgaacttctgcctctagaatgaagggctcaaattcttgcaattattctttagtatttaaagtttaagaggagcattatcagcagttatcctgaaaatgatctaccagtaaatgagattaataaactaaacacaatccaataaagcattagaaaaattgaaaaacaatggttaaaagtatgcattttcaatgactgaaaagagagcataacagatataagtgtctaatttctcaaaattacgtgatcattgcagcaataatctatgaaaaggaaaagtaagcagctttagaaaaatgcacattttaaatatagttaagaaatatacattgatatcttaaagatatcaatgaaatactctcatggaaaattagagccacttacccaatgagttccgagataaaataactacttgaattcccaaagaaggaatgttccttgtgttcctccttttgatgatagttttggcagtgtggtgcttgtacatatttcctgtggaatgttagctattcagaatctaatggaagttctatttttataggtgcattgagtcttcttctaatgaaatgatttttactttctaaaaaatcaaaacaaagaacatgagttctatgaaaaaattttcttctttttttttctttttaaattttattttattatagagatggggtcttgctatgttgcccaggctggtctcaaacttccggtctcaagctatcctccctcctcagcctccccaagtgctcaggtgtgagctaccatgcccagcctcttcttactgttttaaatatatatatatatatatatatatatataaaatagcaagaaatatatagaaagatatatataaagaaatataatagcaagaaacatatataataacaagaaatatatatatttcttgctattttaaatttatatatttttattcagttatctagccatttttaacaataaggcattagtagtctcttttgcacatagactcaggaatgaatgggaaaggcttttatgaaagcaaagtcatccccttcctgtatccatgtgttctcattgttcaattcccacctatgagtgagaatatgcggtgtttggttttttgttcttgcgatagtttactgagaatgatgatttccaattttatccatgtccctacaaaggacatgaactcatcaggaaggggaacatcacactctggggactgttgtggggtggggggaggggggaggggggagggatagctttaggagatatacctaatgctaaatgacgagttaatgggtgcagcacaccaacatggcacatgtatacatatgtaactaacctgcacattgtgcacatgtaccctaaaactgaaagtataataataaaataaaataaaataaaataacgcaaagtcatctttacagcaaataatgaactgccctgatttttttcaaataatcctttccagggtttgtgcctagcatggtttctaggcacacctcagcggctctggagaacaaggagggctaagtttatagagatgtgaatttaccgaaagataagagaagtggagctagattgtagtccccaagggagaggccttcaggcagagacttcagccttaagcagataaggcagatcacagatcaagttcatttctagggctaatggtaaataaggctttaacatgggcagtcacctgaacatatgtgttggcttgaaaaattgttttccctctacccgttttaggtttatcggctgggaccccgcaaattagactgacaggagaaagattaaggaaaaaacaaacaaacagacgtttattaaactgtgtataatacgttcacatggaagcactcagagatgagtaactcaaaagggtggttagaacttcagcttatatatcatcttaaaagaacaataaattcttagagaagagacaaaacaaaggaagaggactttgagtctataggaacagcaaattgtatgaaggtaaatagatgaggataattaatggcagataatggctggttgtagtaaagtttcttatgcggattcctctggtgcagtctccaggctcaggctctaggttgtcactaacttctgccttccctggagagagggcaggagagaaaactctacaaatttatgtcatgcttttaggcagacagagggaaagcaaagagctttatctgtatctgcttcttcacaattgccttcagcaaaaaataatttttacaagtggcatactttggagtgacatattttgttacccttcattaatgacatttatttcaggaactgtatgtcagagaaaatccgtattatgtgtttgttgagtgaatacttgttcaagagaccaaaaaaaaaattagtaattacagtacaatacaacgtttgccacgatattgttctgtgtagacagcttcaagcaaaaatggacttagtttagagatagcttagcccagttagaagtcactgaagtaaggtgttgggagaaataaaaaaaaaaagaactaaaatagtgtaatccctttgaaaatactttatagaacatagctgagtctacaaattttgtttcaagatcatcatttgtatttaagaaggaggctgggcacagtggtccacacctctaatcacaagtgctttgggaggctgagacaggagatcgcttaagcccaggagttcgagaccagcctgggcaacatagcaagactctttgtctacaaaaaagttttaaaaatcagtctgtggtgatggcacttgcatgtagtcctagctgctagggtggctgaggcggaaaatcacttgagcccagaagttccaggctgcagtgagctgtgatcacgccactgcactctaggtgacagagcaagaacctgacttaaaaaatgaaaaaaaaaaaaaaaaaaaaaaaaaaagaataaacagttaatctacataaaatgcattatattttaaatagcaaaccctgatgctataactatactaaatttcttgtttgtttttagaaaatggaattttgtttgaatcaaaacatctgggctattttaaaatgaaatttaatgttcattatagtgaaaaccaatgaatctagaattttagtatgtctcatgtgggaaaaatactggttttccagtacgtatactaacaattttagtggttttttttttcctcatgaaagggcatatccggatcgtgttccttttattgaaaaattaataaaacaattaatgattttgttatattttttaaggaagaacactttaaatgctcatgacattctgtccttttaatagaaagggatgctttgtcatatacttttgattctattctgagtggaaggcaaaatacacgattaacttctctctattatggtgctccacagtggcaaattaaatccttctacccacgtatcatgtttcctttatgttcgtgaaaactttcagtttgtgtgggataagatataaacttgtctcctaaagactctttagttacaacctacagaaggaggtaggttcttcgtgataaatactatttgatatcagaatttttttcagggataattgtcataaattccagagggcctatttctattttgtttctttgctttagtaatttttattctttgatgagaataaggatttcttcttaacatatctataccatcacattaattctgtggctcatgcttgtaacctcagcacttcaggaggccggggaaggaggattgcttaagcctaggacttaaagatcagcctgggcaacatagtgagacctcatctctacaaaaacatttttacaaagtagctggtgtggtggtatgcacctgtagtcccagctacttgagaggctgaggtgagaggatcacttgagcccggttcatcaaggctgcagtgagacaagattatgccactgcttcctagttgacagagcgagaccctgtctcaatttaaaataaaaatggtaattattattattattgccctttttaatacagatctggatttcttggtgttatatcacctcccatatttattataattcatcttcatgaagttagataaaatattgtggactataggattttttgaaactttgacaattctttttaaacttctaataaactttatattttagatcagttttaagtttacagcaaaaatgagtggaaatacagaaagtttccatatacccttatctctacaagtttaccacctcctacactatcaaaatccccatacaacattagtacattagttataatagtacattgtactactgtataaacctactttggtacatgattatcacctagagtccataatttatgctagggttcactcttggtgttttacattgtatgggtttttaaaaatgtgtgacgttctgtaaccacaattgtaggatcatacagaatagttgcattgccctaaaaatcttctgtcttctgcctgttctgtcctccttacccccaacttctggcaaccactaatcttttactgtctccatagctttaccttttccagaatatcatatagttagaatcatacagtatataaccttttagattgatttctttcacttagtaataaagtcagccctgggacaacatgggtttgaactgcacaggtccacttatacgtggattttcctccacctttgccattcctgagacagcaagaccaacttctcctcttcctcctcctcctcttcctcctcctcctcttcagtcttctcaatgtgaagatgatgaggataagacctttatgatgacccactttcacttaatgagtgtaaatttattatctcttccttaggattttcttagtaacattttcttctctctaacttactttattttaagaatacagtatataatacacgtaacatacaaaatatgtgttaatcaactctgttatccttcaggcttccagtcaacagtaggctattagtagttaaatttgtggggaatcaaaagttatacaagggttttcaactgttggggggttgatactctacccctcatgttgttcaagaatcaactgtacatatttagatttcttctatttattttttatggccttatagcttatttccttttgtcgttgaataatatttcattgtctggacgtaccagagtttattgacttacccaatgaaagacaccttgactgctttcaaattttggcaattatgaataaagctgctataaacatccatatataggtttttgcatggacataagttttcaactcatttgggtaaatacctaaatgtgctgctgatgaatcatgttgtaagtgtatatttagttttctaaaacactgccagtattcttaagtggctataccattttgcattcacaccagcaatgaatgagagttcctgttgctccatactgtctccatagctttacctttgtaagaattctcaccagcatttggtgttgtcagtgttcttgatattggcctttttaataggtgtgtagtgatattccattgttacaatttgaaatttcctaatgacatacaatgattaacatcatctcatatgctcgcttaccatctgcattcttctatggtgaggtatctcttcaggtttttcatccatttttttattagattgttcattttcatgttaagctttgagggtgatttgtatattcctagcacttcaagaggctgaggcaggcagatcacttgagtcaagaatttgagaccagcctggccaacatgatgaaaccccatctctactaaaaagacaaaaattagctgggcatggtggtgcatgcttgtaatcccagctacttgagaggcttgaacctaggaggcagaggttgcagtgagccaagatactgcaagccattatactccagcctgggtgacagagtgacactccatctcaaaacaaacaaatggacaaaaaagagttatttgtatattttggataacagaagctttatccggtgtgtgttttggatatattttctttcagtctgcagcttttcttatcctctcaacagtgtcatttgcagagtggaagtttttaagtttaagtttttaagcttatcaatttgtttctttcatggattatgtgtttggtcttatatctaaaaagtcatcagcatacccaagatcatctaaatattctcctttgttttctgggaagttttagagttttgtgttttacataaaacataggtgtgtgatctattttgagttagttttggggaaaggtgtaaggtctgtgtctgcattcatttttttttaatgtgagttttcagttgtttcagcaccatttattaaagaatgttttttccagtgtattgcctttgctcttttatcaaagatcagttgattgtacttatgagagtgtatttctatactcaaagatctgttctgtaccgttgatctctttgtttgttcttttgccaatagcacagtgtctgattgctgtagctttatggtaagtctcaatgttgagtagtgtcagtcttctatctttgttcttttccatcaatattctcttggctattctgggtcttttttcttttcatatgaactttaaaattggttagtatatatcaaaaaataacttgctgagattttgattgggatttcattgaatctgtagaaaagttgtgtgtgttctgactgcccccactgactggccattcccccattctttccctttcctcaggccttcctattccctgagacacaaagatattgaaattaaaccaataaataacttttcactggcctctaagtgctcaagtgaaaggaagagtcacacatctctcattttaaatcaaaacctagaaagaattaaggttagtgaggaagggatatcaaaagcagagatatgctgaaagctagacctgtgcgccagttagctgagttgtgaatgcaaaggaaaagttcttgaaggaaattgcaagtgctattccatttagcaaacagatgataagacagcaaaacagccttattgctaatatggagaaagctttattggtccatataggtgatcaaaccagttataacatttccttaagccaaagcctaatccagaacaaagccctaactttcttcaattgtttgaaggctgagaggggtgagaaagctgcagaagaatagaggaaagctagcagaggttgtttcttgaggtttaaggaaggaagccatgtccataacaaaaaagcgcagtgtgaagcagcaagagctgatggagaagctgcagtaacttatccagaagatctagctaagataagtgatgaaggtttgtgcactaaaaacagattttcaatgtagatggaacaatcttctattggaggaagatgccatctgggactttcatagcttgagacaagaagttttaaaggacagctttcaagaacaggttaactttctcatgagggattaatgcatatgatgactttaagaagacatgaatgctcattgaccattccaaaaattttaggacccggccaggcgcggtggctcatgcctgtaatcccagcactttgggaggccgagatgggcagatcaccaggtcaggagatggagaccatcctggctaacacggtgaaaccccgtctctactaaaaatacaacaaattagccagcctggtggtgagcacctgtaatgccagctactcaggaggctgaggcaggagaatggcgtgaacccgggaggctgagattgcagtgagctgagatcatgccactgcactccagcctaggcgacagagcgaggctccatctcaaaaaaaaaaaaaaaaattctaggacccttaagatagatgctaaatctactctgcctgtactcaataaatataacaacaaagccgagacgacagcacatctgtttacatcatggtttactgaatattttaagcctggcattgagatctactgcctgggggggaagaaaaatgatttctttcaaatattactgcacaccgacaattgacctagttgcccaagagctctgacggagatgtacaaagagatgattgttgttttcatgcctacgaacccaacatccattctgcaacctctgggtcaatgagtcatattatcttttaagtattattattaacacattttgtaaggcgatagctgccttagatagtcattcctctgattgatctgagcaaagtaaattgacagccttctggaaaggatttaccattctagatgccatttaagaacattacttattcatggcaggaggtaaaaataacaacattaacaggagtttggaagaagttgattccatctctcatggatgattttgagatgtttgaagcttccagtggaagatataactgcagatgtgaaaatagcatgaagactataactggaagtgtaatctgcagatgtgactgcattgatgtaatctcagcataaaacttccatgaatgaggagttgcttcttatgaatgagcaaataaagtggtatcttgagatggaatctactcctagtgaaaatactgtgaacattgttgaatgacaacaaaggatttagaatattacataaagttaattgataacacagcagcagggtttgagaggattgactccaattttgaaagaagttctcctatgggtaaaatgctatcaaacagcatcacatgctacagagaaacttcctgaaaaaaagtcaatcaatatgcagcaaacttaattgttgccttattttaagaacctacgacagccaccctagctttcagcagccaccaccccatcagtcagcaccatcaacactgaggcgagaacctccaccagtaaaaaggttacagctcactaaagtcttagatgatcattagcgtatttagcagtaaagtattttaaaattatgatatgtcacattgtttttagagataacgctattgcacatttaatagaccatggtatagtgcaaacataacttcatatgcactgtgaaataaagctgtgactcattttattgtaatatttgctttattgtggtggtgtggaactgaacccacaatatctcctatactacttcatgggtagtatcggtatcttataataacaaaatgttagtcttctctcctgtcccttgtatcactgctgttatttatttcacttatacataagtacacacacacacacacacacacacacacacacacaagcatacataattgaataaattgttgctattattactttggacaaactgttacctattagatcaatttagaatatgaaaaatagtttttattgtcttcacttattccttctttgattctctttctggctgtagatctgagtttccaatctttgtaatttttcttctcctgaaaactttgttttaaacatttcttgcaagacaggtctacagtttctttttgtttgtctgagaaagtatttattttctcacatttgaaggataatctcacagaatatagaattctagggttttttggttttgttttcttcttaacactttgtttcattccacactcttcttcttgcctagtttctgagaatctttgtaaagattttttctttgttttttctttttctttgtttttctgatgtttgaatgtggtatgcctagggattgttttttagtatttatcataccttgtgttctctgagtttcctggatctgaggaaactgtcaaactgttattgctgtctcacaataattattcaggaagttatcagtcattattgcttcaaatgttgttactatttctttctctctttcttctccttccactattcccattacacaaattacacatatttacactttttgtcatcgtcccacaatctaagttgtcttggatattctttgctttcttttttatcagtctttttcttcctttgctcttcagttttagaagttttttctattgtcatatcttcaggcttagagattcttttctcagccctgtctagtctactaatgagcctatcaaagacattctccatttttctggtatagtgcttttgatggtcaagctagcatttctattggattctttcttagaatattcatctctctgtttacatcatccacctgttcttgcatggcatcttattttttccattaaagcccttcatatatgattcacagttttaaaaaatgtctggtctgatcattcccacatatttgtcatatttgactctggttctgaaactttttcagtctcttcaaactgtgtttttgccctttagtatgccttgttatttattgaaaggtgggcatgatgtactaggtgatatggtttggatctgtgtccccaccagatctcatgttgaattgtaatccccagtgttggaggtggggcctgctgggaggtgattcgatcatggggttggatttctcacgaatggtttagcaccatcctcttggtactgtcctcgtgataaggagtgagttctcctgagatctgttcatttaaatgtgtgtggccttcctccttctctctcttgttcctgctttcagcatgtgaagtgcctgttgctgctttgctttctgccatgagtaaaagctccctgaggtctccccagaagcaaatgctgccatacttcctgtgcagcctgaagaagagccagttaagcttgctataaattactcagtctcaggtttttctttatagcaatgtgagaatggactaatacactaggttaggaaaaaaaaaagcacaactctggtaaataagccttcaataataatagtggtaagttatggggaaagaggaagcattctgtagtcctatatttagatctcagtcttttcataagcctgtacctctagactgtgatctacactggtgcttaagggtacagctgggtagaattggggatttctatttccctaggtttgttagactctgataaaaccccagcaggttgggctctactaaagtagttgttcctgagggcagaccttgttaagacaaacagcattctctgccatatttcaaagttgtttcttttctcctccttcttccagaagcagaaagagatttttcctctggtattcactgtgaagctctgatacaactcttggaagtaaaactcacagaagtgtgaggatccccttaagattaggtccccctaaagtttttatctttcagacttgtccacactgatccttcagcaattcatcagttaaaagtttatgttttcctacctcatgatggttcagaggaggtttctgctcgtggatttctgctctgataaattgtgacactctatcctaacctgtcttactctccaattttaggggcagcagtttgcactgtaaactcacttctatggcagatctaagaagagtgttaatttgtcagtttgttcagtattttacttgttctaattacagagtgatggacttttaagctccttacacaccataccggaaaccaaaagtcctcataatgctttatttaaaatgttaaatttaggctgggcacagtggcttatacctgtaatcccagcactttgggaggccagggtaggcagatcacttgaggccaggagttggagaccagcctggccaagatggcgaaacccaatctctattaaaaatacaaaaatttgccaggcatggtggcacacacctgtaatcccagctacttgggaggctgaggcaggagaatcactggaacccgggaggcagaggctgcagtaaactgagatcatgccactgcactccagcctgggtagagcaagagactctgtcttaaataaataaataaataaaatgtcaaattttataaaaatccagttataaactactaaatggtttggatttgaaaatacaagcaaggcataataattcattagctggaggtcagaaatcaagactagaaatttacatttttaagacatgtttaagattattagtttgatctgtttcttatatattataggttgccgagacggataataaaagcagtttgatatttctcagaaaaaaaaatctgaaactttaaaaaaaatcatactccattggaatttgatgttgaggcattaaagagatttactacctcttttgtttaactagattttgaaagcacaattttctcaaaaagttaattaaatgtaaaatcatggatgcttattaaattggtgccttcttaagtaaattcttttcagcttctgggtcagatggttctccttgaaagaggctagaattgctgtattcagtattaattgccattttggagacaatatctgtggactgtcagtgacattctgctatgaaagagaatctggaaaagttacaatttaaaacatgttaggctaagtttagcagtcagcttcttcagtatgtgatgatattttctgccatgcactcatccatttcatctcccagcctggactttgcagacaggaagcccaactcccacttaatccctgcttacttttcacttctacttgagacacccaaacttggcaggttctgctgtcggcttgcagttaaccacaaccaccaacccccctcagctttggtactttagacattctctgtaaatagatttgctattataatacattcattcaatgaatacttattaagtactaattatatgcaaagaactttgctaagtactagaggtaaacccatgaataagacatatctgcctacaaagagcttacaacctagtagagacaagaaaccataaactgtggtgagccctaagacaaggtgagctcccagaaggaaatggtgtctaatgagctggggaatgggaagacacagaagactctacattgagtagaatttacttagtcacagattctagctcctccctgcaatgccaagaagaacaacatgtgcaaaggcccagaggggacagacgtggaaaattgtagaaatgtagaggttagtgtggatgagctattacatttaagggtgaaaggagagcacggtaaggctctgagaactgaagaaaccagctgggagcaatttccaaagcaacttccagttttaccatccttgcattaaaatgtgatcctgattttttaaaatagagttaaggggagtgacctgatgagatacacatttagagaaatcattctagctacaagttggagaacattggcatcctagtgagagatgctagtttttggaactgagcaatgcagtgggagcgaataaaagtggaaagtttagagagtaattaaaggggtaaaagtaatagatatgatgattaattggatctgaacctcttctattgaagccttctatttagaacatttcatttctaaataactacaataatctgattagagaaaagaagattttatctctcatgatggtttgactagctgatagctgtgtcattgacaacagttaatgcaatgacattgtgttaatagacatttagcagactcagaaataggtacttattccctttttttttttgaattttgactacgtgaataaaataagtaaaacttctaaaataggaaagataatggcaataggtcccaggaagctatgtgacttgacaaacaagcagattttgagagaagaccttccttccctttactaactaaagcaaggatgtaaacagcactaaaacataccaggcactcaacaaacatctgttgaattgttgacttattagttgtttaatgttgacttattatttcacattttaaataagtcaaaaagtagaagcaattattgagcatacatcagctgaaatttaatatattcattcttgatgtatacatgtattttacctaatatacagtcatattgtgtgatatgtgtcagttctgtgaggtagtgagggcaaagatctaactgagtagagttattctgtcccagttattttaagtaagatgttacttttgttttaaagaatatatgaaagagaaatattaattagatttttcataaatgcttttgaagtttataagttttgaattacaaattagtaatctaaaattaaccagaacttttattggagcctcaaaaaaagctttcaaagtagaactggaagaaaattataatttatgatcttgttcatctttcttctttgctgttctcgtgtagtgatagacgtgttaatgaaaagttttatgcataggaaattgactatcttgaatcatgattatccattgactttcactgtaatttcttatatttcttgttaaaagggaggatggggaatcagattttagaattttctttaaaggagttctgtcattctcctaaataacatacttttttcttctgtgtctgatatatttccatttaattgcctgatgtttctcttagcaagaaattaaaccaatatactatcaagttaacctgtctgtcttccctatcagatagatctctatctatatttgttttctcagtgtcttgctcagtttctggaactagaaaatgctcaataaatattcattgagccaaagtgaatgtttaagattctacattcatttatccattcacttattcattcaacagatacatttagtgtttttttatgtagctggtacagtgctggtccctgaagcccaaaatgagtaggattttgtgcctctcttcaagatattttaagtcttttgaatattcatttaaccttattaacatgcatatattcaaaatatcatagaggtaatttggccataccatagaggtaatttccttccacccttttgtatcttctttgcgggttcttcctcatctcccagacatttaaacgtaggagtacaagggcttggtccttgggcatcatgcattctctgcttatacttgcttcttaagaatctcatccagtatcatggctttaaattattccatctataagctaatgatatccaaatttacaactgctactcagacctctacccaaactccagacttgcgcattctgttgcctactcactatctctacttgcatgtctaattggcatctcaaatttaagatatctaaaacagttctcctcatctctctaaggtcaaagttactcctcttagtggcaactccgtctttttcaggctcacagtccaaaaaccttagagtaattattgactcattgcgcccttctcttacttaccatatttgactcatcagcaactcctattagattcaaaatacattcagaaactgaatatatttcactccgctccagccatactgccttactcatagcctggtgcatgctaggcatatctcaacttcaagacatttgcacttcttgaatctaatatattcagaacttgaatctgtcagaacttgaatatatcttgaatctccacagcacccccttggccaaaaccattatcatcgcttgctggatcactgtaaaagtgtcccaactagttttcctctttctaccctcaccttcatatagtcttctctcaacacagtagccagagagttcctatcaaattccaagagcatgccactcctctgctcaaaacactccattgccacattgcctactgctctccttctgacccactcagccccagccacactgcctacctcacagcctgggacatgctaggcatattgcagctcaaggtatttgcacttcctctttccttggccctgagtgttcctctcccagaaacctgcatggtctccccagctctcctctcagagcttggctcacagaggccttccctgcccaccaatctaaaagttgatctgctttcttcaccaacttttcttaattccttccttggctttttttttttttcttttttgacaccactattaaactaccatgaattaatttatctggttaattttctatattaccaactatgacgtaagctccattagtgcagggacttttttctcttttgatcactattatccccagtgtctagagcacataacagatgttcaataaatacttttgcagaagagcacatgagaaaacttctgggaagaatatagcattgttttgcaaagggtttaaagagttgtaagtgaatgttttaggttttctttcatctacttgctactttggttacataatggtgcctcagtgccaactattgcctaagtaatagttaattagtatgctcagaatcatagaaattgatttttggtcagtactaaaactagagatttggtttagccaagtatctgcttttgagcaaaatgagacatcatgatacgttttaagaaatgaaaatagttatgcctgtatggtctaaatagaggcagtgttgtctcacatggtatttatgatgtacttaaattgaaatatgatttttctttattattatgatgcttaatgatttgaagtatcagtatgtaccatttaccttgtctttttcttagaaacatttggctacttatttttagccagcaagtaaagtaggatattcaattacccggggagcctgatactaatggctataattatttaagcaattgaagtctttcctgtcattttctttctcaaacccacaaggtgccaagactgaaacatgcaacgtatatacatggattaatatattttctcagtggttgcattcttcaatggagtctctggaaagaaagactcttttgtttgcttttttaatctcttattttggaatctgaaaactattcaaccctttccagaaatgttgacccaaatggggcattttcatgggcagaaagaaatattttctgcctgctcttgcttgaacaaagaaacctactgatctggatgacatcatcatcatatttggcttcttttcctagtattattgatgatacagactttttcgaagggtatgcttagctgataattgtgaaacccaaaacacttggggactatgactagcgtgtactgatgatagacagcctcatgccataggaattgcaatatttagacctttaaaatttaggcccagagtttggaaaaactttataactgactgttactaatagtctggagaaggaagaacactttccatatacacttagatttaaagcattgtttctgtaactttgtgtttcaatattaactatttctcaatgaaactatttctcaaagcaacctcaatccttcagttctctttagttgttcagataatctcttcctaaagaaagcaaaaaataattaagaataaagaccctgctcttccttttgagtgttacggtgtgaaagagagttttagagactgggatgttgtctctgctgaaaaacctaactatgtgaataagacctaagagtaaaaagccatagtcacaaatgaaatttgcctcaggcgcatgttactgaattgcctttatcagcatgtgaaattacttgaaagtcattttgattttgtaaaagaatgtctggccttaataagagtgaacatttgttaagcacttaccatgaactcctccttctcaaactgacaagcatatacacattgtctcattgacagtaactccataaggtatatagtattattctaattcttctttacagatgaaattgagggaggagagtttatttgctttacctaaggtcacagagtaagtggctgtgctaggatttaaacttagatttgcctgacactgaaaatagtgctatgaacaactgtaaaatattgctttatatttactctttagcagaacttagatgatggggtattatgtgcttgcatttagttttgaatggtttgtttttatctctttccttaaaacaaaagttaacaagagactttctgaagtcttattttttattcaaactgttttttgtatcccttccttgttccatgaccctgttcttttacctgcatgccctgaacatggagctaacggaccaccaattttgtctctttattactataaccagcgaatattcatagatagaggcttttctgtaagcttctggatgttataagctctcaatcagtagtactggagtgggtttgtttcttaaataaagagataaagcctaggtttgtgagagctggttctatttggaccaaagcatgatcagaaggtgttttagtaacagaattgagctgagcctcacaacctaggttgttctattgagaaaagaagtgtgaacaaaacctttgtagctagaatcacatggattgatttgggggtgttttgctgaaaagtggttgacaataacatgtaaaaattagtgcattcttcaggactctttatattgcaaggggcagcaatccaaaatagctttggccaaaaagttaacttatttcctcaaataattgagaaaaatctgtgagttgacctggtttcaaatgttgctcaatggtggcccaaattcagctggtctcaggtcctcttttctactttattgccaggcacatttatccaatatggtgacctccagcagttccaggcttacatcattcttacagcaacaagtgttattgcaaagatagccttttgccagttaattccaacaactctatgaaaattgagttgtatagttcatccttgaaccaattactctcaccaagggaattacatgctagcttgtggagctggaaacaggtggttgtcaaaccagtacaggacacatggaccaagagtaggagagtagtttactaaagcaaaaaaagtgaaacaaaaaacaaattaaaaaaccgcataggtccactacagtcagacagaaagaagaggcagccaggattcaagccaggagcaaaatttcctttgaaggaaaggaaacaatgtggccaaaagtgggtagtctaggtgaatagcaacaaggcatatacatgccaattaaagctcttttcttaaacacaattacttccagtttaatactggatgcaatacttaagttatctttacaaaactggaactgcatttttaaaaagtgcttttattttttggcacaaagttctatatactaatctatactatactatatactgtactatatactatctatactatatgatatactaatctatatatacactaacctatactatatatatactaatctatactatatactaatctatactatactgtatactaatctacactgtaagattgcatatttaattcagtcattatcagagaaactgagttttcctctgaccatatgcctttctgattcaaaaggttaaaaaggataaagatgtataaagtagcacacacaattttatgaaatcagataacatctgtgaattaccctgtgtatacaaaatacatgtgtatacaaatatgtgtgtgcatatatacacacatgtatatgtgtgtatgtatgtatgtttgtgtccgtgcacacacatgaggctggggaaggacaacgagtgaagtctagggaaaaaaatcactttagaggttcaactgcaaatctgaaattcctcacgttgattatatgaaatattgtcttttttgttaattaattaatcaattactcttgcctgaatttgaaattcaaatgatacctggtcttattttacctatagataatttaatgcacagagataaatatgttaacctgttttgtctcctctcctctagtggaaaaattgtggagactattaattaaggaattgaacacattatgtttctctaccagctactaaaaataagctgagaagtctctagttacatttggcccaaagtgagatgatgagaaaggacagcaagctggtgtgggacccggataaacagcaggggagagtgactcagccctctggttcccagcttcagcagggatctgtgaatatgagtgagcccttcagtttttaatgggtctttaggcagaaatacgtaaagaaccagaaaactttttttttcttaagataaaagataggcatcattaatatcttttatttttgttgcttagctattgtgttcttttggaaaccaccacaatttaactgcaagaccaacatttcctcattatatgtagcctgctgggtctgccccagctatctttttctcccttatctaaggggtgagcataaaacctgaactaagcttgtgaggtacacccccttctctggaatttgtaacctgagccaaataacttacggactgaaaatagaagtgaactgactggtggagagacacatctgttcccaccacctgaaaccaggaagcctctctggttcatgattgctgagcctgcttcctcaggcctaccttttgttttgtgagctaccccaaagccttccaagaaacctctcttcttcctgcataaaccaagaaggcctggctgtcctgtgttttctctcctcatcatcggggtgaagagagaagctcaggaacatctccagctcccatgcttcacattctacaactcacacagccttcgggctttgaaaccgtttggactcacttaattatcccttttttatttttgcttatggtaatcaccccaagagctctcacactttgaggtcaatctccatctcccacattctactccccataggttcttgtacaacctaatcctaatgctgaaaacatgagatcccagaattcacgtccactcagtgcagtgactcttggcccacattctgtagataagaaacaccttttactgacaatggaaagactgctagaaataacttgagatacccaggcatagtcttatattatgttggggttttataatgtaaatgcaagaatcagatttctccataccccagccaatgattaagctttatggaagactggtttaggtttttctgatctgtaaaggcagactaaaggctgcagtacatggtggccttcactcaggcatttcaatctgtctgcactgaacactgagacactagtaccttagtccacaatgggaataaaatgcacatgcaggtgatgttaatctacatgaaagatgctgaattccataacagaaaaaaaaattacatgtgtgtgtaatatgaaagaattaaataacttcagtaagtacattctatctgtacccttgtcttttataagggtaactgtatataagttaaactagaaattttatttttaaggggtcccatttcaaaccataagtgctttaaacagcaattatcagctaaattttcctgctggcagcattactagagatatgttgtttctgggcaaagttatccagaggaatcctgctccctcgtattttggaggagttgagtttcatagcatgtgataattacccatttttaccagttgagtccaagttgcaactcataaggctgctacagtgtatttctaagtattgtttaaattggaactttaaccttttatcctgggaaatgattggttttgtttttaatctcttcttagtggattctgttattgcagagagcggtatcagtagagattgatatttttgtaggttagcttcagtataccacatgaaatacatccaatgctcataaatgaggcttttattcaaattcttaatcaacttgcattttttgtgccctatgaagggtatttgctaaataatgcacattggaattcaaaaccctggaaaattcttgtttaaaaccagtggtacatctcagcaaactgggtggagactgagggcaacactcaagataaaatttagcatggcagcaatttaaaattagaagcccttgatgaaagatgagacctgttttaggccacttggtgagccccaccttttaaaggcaggatttgactccactgaagagctgagcagtcacgggaggacagactgtctctgccccaatagggaatgcctatcttccgatttggtgtgtgacggtgttaaataaagctgtgacctttgtttatctcccaagcatttccacccctccactggcagaatgccatgggagagtgtccatttatcggcaagctgtggtctaaattcagatactgtctaaagcttataacaataagtgtctactgtatatactgtacagagatgcttcacctgagcccttatacattacatgtttcatgaagttctagcttaaagaagtccctttaatatttatttaaataacagcctgaaataggccatgagtaaaaatactcaggtctcagtatcaatatatataatgtttctgttacctcttaaaggcaaattttttaaaaaggaaagttcctcagtaagagcagcttatcagctcgcttctttaaggtaaaaggagggatacttaaggtgtacatttttcagaatttttagatatgagttaatgatagaaacatactttgacttgatcacatgatggttacacgacgatatgtgtttgtcgaaactcagaactatacaccaaaaagagtggattttgctatatgtaaattgtacctcaataaattcaggttaaagagacagctctgctaaatagaaacgtgtgtcctagatttaaatgcttttatttgtcttatggtttatatataaatttccttcctacccctatcctattcatggagaataaatcctacgcacaccctatgtgggtgggccaccctacatgtcacatgattctgacctagacaatttattggatcaaatgtaaacatctaactggtcaacctggatgtgaaaccaagacagaccaaaattctaaagtcttggagatttgcggccagagtcaaaatatgctctccaaaagccatggttaagtgagagttatgaggagctgcaaaaatgagttatgcaaaagaagccaatcagaaggaaggagaattgagcaggcagacagagaatcattgagccagcgtccctttctcgtcatggaaagggagatgagcatagtaccttgatgatattctagtttcccagaggcctagctgaacttataattgaattatctgactttcccctacagatctacttttacttaatatagctggtgtgagttctagttttcatgaaaagacaggaaaattacccaatgacatttaatgttcttaatcccaaatcacaggcaaatatcaatgttttgctagcaccaccactttaattcctaaagtagaaggagtagaaggctgtagtagtgggaaggaagaacataatcttacggaagtctgggttatttctgtgagctcagttttcacctgaaaatttcagaccttttaaagaaaaaaaaaatcaaataccttctaaggactaagttaacacatagcctggtctttttcttttcttttcttttcttttttttttttttttttttatgagaaagttttgctctcattggccaggctggagtgcaatgggaagatcttggctcaccgcaacctccgcctcccgggttcaagtgaatctcctgcctcagcctcccacgtagctgggattagaggcatgtgccaccacacttggctaattttgtatttttagtagagacacgctttctccatgttggtcaggctggtctcgaactcctgacctcaggtgatccacccgcctcggcctcccaaagtgctgggattacaggtgtgagccaccgcacccagccagtctttctttttttcttccttctcagttatttaggtatagaaaaggtcaaatagaataacaattattgattctacctccttatattaataaaattattctgtttgtgagaaaattattttacctctactttcacactgcatttttatttttgtttttatttttagtgctggggcacatgtgcaggatgtgcaagtttgttacataggtggacgtgtaccatagtggtttgctgcacctatcaacccatcacctaggtattaagcccagcatgcattagctattttttctaatattctccctccccccaccctaccccacattccatttctgatgactgatatatttaaaaaaacagaaaggtcacttcttctgaatactatagtatagcttttaaaaataattatagccaacttgaattaagtgcttaaatatgtggtattcattgcactcagagccctgaatacattatttcatttaatcctgataatcttatgaagtagttgccattattatcatgattttacagataataagccttcatgagttaagatagatacctgtagctctatggtagtaagtttttacacctgaatttgataccaaacagacctacttctgagtctgatctcttaatcacaacaaagagtatatgcaacaagaagtatgtatgttttacagctaaggaagtaatcataaggtaattgttggattttagttagttttctgaatatcttttctaactagagagacagttatatctacggttaagaaaatgtggtacatcttactgaatcagtactaaatcaatactaaatgtgtaacattatcattgtgctatatttaaaaggttgatatattgtagcactttaatgaatacaatatgaaaaaccatttctgtttatgttcatgtgagagtataaactatgtatttgagaacactcagcaactgtggcataacagaatatcccaaaagttaatgaaccaactgaggagtgttaagttattcatgcacatcaaacatgtcattttctcttgcctttttaattggttaagtatgtcagagtttgaaagagcttcattaataaggtcatggtatttggttttaaaatagaataaaataaatgagggattacacttttgtttagaaaaaatgagatagtatctttcattgtaaaatctgggacctaggaggaaaggaaaccacatagttatgtaagtagccatgcaggccaaatttggccttacatgtgggtaggacatggaactgttggttgaagaaaaactcttctgtactgtcaactggaagtcttgggatgggaaacctgtatttggaaagctgactttttcaaacagtggctgtattttcagtaaatatttcaagaattctttttctggtttttaataaagttctctgttttaaaatgtcaggctctttcaagcatgctgggttagtctgttttgcattgctgtaaaggaatatctgaggccggataatttataaagaaaaaaggtttattttggctcatagttttgtagactgtacaagaagcatagtgctggcatctgcttctggtgagggattcaggaagcttccaatcatagtggaaggtgaagggagagcaggcagtgtcacatggcaagagagggagcaagagagaggggaagaagtaccagggtcttttaacaatcagctattttatgaactaatagagtgagaactcagtcactgttgtggcagggcagtgggcagagggcaccaagccatttatgagggatccacccccatgacccaaacacctcccactatgccccatctacagcagtaggggtcacatttcaacatgagatttgatgagaacaaatatccaaaccatatcacatgctaaggggaaacatgcttaaggaaaagtaaaaggaagagcatcatgttactttgagaattggtgttgtaattccagagagaaggagcagccaaacctggatgagaagcaacaattttagcaaagactcaactataatatagcacctgtctagccatttctgcttacagaaaaattcctctgcatagcttagtctccaaaaacagtcagtggaatatagtttttaaactggccttttgttatatccgtgttaggagagcagataatgtaagtgattggtacatataactcaggctgtctcctgatttgtacagtttgcctttttccatttattctataaagttaagagatagtctttggtttttgaagaaaggagtttttattttgtagcatattttttaattgtttgtcattcttcagatatactcagttttatggaagaatttgattgtgtagcaatggtagcagacagtagctcaatgctattttctgccaaaggacaggacatgcctctgcaaattgctcttcactgcattagatgtggatttttttactcttaaccttctctgttaaaatcttacgatgacttttaaaatttgcaagtgtttaggggaagaaatgagaagaaagagctttggctacatctatgtattgttaaagttatctctttagctctgtgaaaaactgcttatttacaaacttgagtaaaatttctggtttaagatatcatatttaaactgtaacataaaatccaatggcacactttcccccatacctaccaaacgagcaaaactagctgaaacattttcattttgaactgatatgaacccaatagggaatgagggataacttaaagcaatacacttgaaaaacttgtctccagtataaaaaacaaacaattccgagatggaacagagtgagtggcacagtgtggcttggtcattaacctactctgtaattctagagctatacaactgagttgacccaatcctgacaattctcacaaataaccaaatatgtagagagacattcttagtgagtcctttttctttttctcttctggccaacaagaattagaaacagagtcccaggatacttgaataaagggggaaatgtgaacaaaggggctgactatgacaggattgaatggacatttcattgctgggaaaatgatccgaaatattaagatactgttccttgggaacagaatatctttcttcaatgaagtgggttgaaccctggtacaaagcatctaatttaaacgacttttagagtggagctcaagtattctgacaaaaacacaataccaatactcagccagattctgcaaccatcttcctcctgtcagtctttcaagctatagaaggatggtaggactgtgaaactcctagcattccatatgtggctcatagtggtggaaaagcatatgatgttatttatggaagggaaagacttaaatcaggtgcactctttcatgacaaatacagagtcttgtctgaaatgtccaaacacatggaacatggggaaaaatatgccatggcacaacatttatgcaaataattatacaagcttattagatctaaaaaaaaaaaatagtatacgaagagcccaaaggaaaaaactgtaacacaaatgagccaaagaaaatctcacagttgtgtcacattaaagaaccactcactaaggacacatattcaataaagagtgagctcaaagcctagaaaataaaaggtatatcgtatgtgtgagaaaacaaatcgagggccaagctaacatcattattgaactagtaacagacaaaatacaaggcatttgataaacagtactgattatgtaattagtgacagtgagaagacttatgatcagtatagtgtatgtggatgaaggagggggagaatggagagttttagagaatctaatgtctatggaacagagctaaagctaattcaacataagggtaattggtgttcctgaatagagaacccaaaatatggaacaacatatgtaactcaagagaacttttacaaaatgaagaaagattgaatctgtatatcgaaagaacacaacatattccaggaaattttgaatcagaacatgaatctgagagatgttctagttaagctgataaacttttaagattatggaaagaattctttacgcatccaggcagcaagatgctatctaatgaaaaccacagcagtaaaaattctcaaatgtgaaaaccaaaaccccaaagtaaagaattcattggactcttcctggggggaggggaaggagaactaacaaaaaacaaaatacaaatcaatgaaagtaaataatttattaatgaaaaacctgtggtaaaacgattggctatgagcatttaatcctctttgaaatgaaatgaatactaaacaattctgggaattaggaaaaccaagagaatgtgaatgtataaatctaggcagtttcacaattataattaacaaaaatagggaaatgagggaggggaattagaagggtgcatgagaatgctaatgtcttcatcttttgttgaaggcaggatgtcagttggtaccgtctaaattaaaacatgtagttaacaaattattctagcctcttaattttttttcaaaattctcttttaaaaaaaatttaaagtgatcttctgagaaatacatctgcagttaaaaagtatttttaaggttcactttgttttttctattaattttaaattgagttaaacttaatgctcagtaaattaagattaataatcatacgagtttgtttttttaatgtgtatgtttctatcgtctgtatacccttctgtgtacttgtgtgtgggcacatgcacacacacacactcttctagattactgtctgatttgatcttctaatattgatgattatttctgttttggatttaagatagctttttcttctttttgctttcatttttatactattcttcattgttttaagtctctatactgagaatatcttattttcattaaagtaattctgactgtttaaaaaggtgaggggttggtaaaggagattagaagcaaacgtgccaataagttaatgggactaaacatcggagatctgtgaatgtagattttcagtctattatgtgttttttaatgtcaaaaataaaaaatattttcaggggccaggcgtggcagctcatttctgtagtcccatctattcaggaggctgaggtgagaggattgcttgagacaaggagtttgaggatgcagtgagctatgggatcttgtcactgcactccagcctgggtgacaagagggagaacctctgtctaaatatatatattaaaagagcttaataagtgatgaccgagtattttctaactttagctagaagatacttataaaaaatatgtgaggcttctcttttaaaaaatagcaatatagtttatgcttcaaattcctacttactaggaagtcagtaagcaaaaaaaaactttacataactaaaatatttgccaacaaatatattcactgaggctcatgcactttattccacaaagactctcaggcccttcatcagaacacatcgctttcatgcattttaacaggttttataatctaatgtccaagcatttaggcaattagaaactggaaattaaaggggagaaatacagaccaaaaaagacaaagacatagatacactgattgcaataacaagaagaataaagagctgactgactgagggtttaaatgaagcacagcaaagaaattagagctacaaaaacattgtggtttgacaggacttggtgaggggccaaatatttctactaacctctgtagttcttaagcaccaaaaactgcataacacagaattgtataatcataattatgatccggggtctttaagaaaattatattttgcatatttaagaattcagagaaatttaaagtatattttgttgtagccatcaaaattaattaaataaagttttggagctcaaaggagcttttgttattttgaaaaataatttaagaaaatagccctgtccctaatgataccaagtgaatgaggtgtttctttaattgttttacattttgttgcataaaacactgcaatttatcatacagacacataatattagttcttctattgtctttctatccatggagtggatggtaatcttcaaataaataattacccttctttttaagttccttaagacagcaaatgagtagaataaaccccctcacttctgtagtttaacagcctacattctccagaggggaaaagtgattacatttactacctgagttttgtggagctataaatattactgtagaaagcctaattggctgttaaaacttgaagaagtgagtgcacagatgctgtgttcattttttttcttcaactgatttcaccatatgctgctgacaaaggaagacttaccctggtaaaactgggcttataagacctcctggagttctcaaattcagcagtgacagtgtctgtctgctgcctatgggattaatgttttcatttatgtgttctctagccatttggaacacatatgtaacatttaacagagtctgagagttggcaaatatgcctagcatttttccactgacgtcaacagagaaaaatgttgttctcaataagatctgtccagtgaagcactttagtcaaaatctaactaagagctgaggcttatcttgcttcacagcttccttataatgtagacatatggttgaaaagaacatttaatgattgcatggcattaaaagtgaaaaagaagtatctcagtttgtaaaccaaaactcaaacttggaaataagctttgcctaaatgcagtgaggaatcaggcttttgggttctaatactagcccttttccttcgtgactgatgaccttggaaagattatcccactattctgtgctaaaatagattatttcaacagtcctttctgagctctaaaacctcataatttatttagatgctatttatggaatcaaatatatttttaatcagagaaatgccctgattgcactgcattgaacaataaccatggcagcaatgtgaagaatatatttgtagaaaggagaggtgaattgggagattgattaggaggctgtctagtaatttatgtgagacacggtgaagcactgaactctgtgggatagggaatgaagaagaggggatcaggtccaggagtattttggagacagaatgtggcaaaaggtggtaaaccactggatgccacagtacggaactgaaagtggagctaaggatttagcgtgattggtgcacgggtaggagttgtgatataagaatgtagattaaaatgaatatattttgcgtaccctgaaatgccttcagaatgtccatgagacatctactgaagatagttaaaaggtaagagagtaataggtggagagagaatgagggtagacagggatattgatgagagactctcacttatgggcagatgagaagaagccagtgaagaagtagatagtaaaaacacaggcaaaaggtgggggagtcagggagaactgaagagtaaagctctgaagagcaggaacaaactaagatcggaaatgaagcctttgatcttcaaggaggaagccttctttcttttaggtaggagggaaggaggaaatagtaagtgagaatttacatcagttcaaggtgtgcactggaaaatgtatggaagtagttttataaagcctctttatttgttatctggaggcttctggttgccttattatacaatgcctgaaggttatacttggattcattattcaattaactgttgcacccacgtttttggtatttccttgcctcttcacctgcagattctgtcaacagacctagtgtgctttattggaatatccagagtaggccatgtgggctgagtttagtcgaagaaatggttgatgattttttaaaaactttcatgtcatgttcgttcccaaaaggagagcatcagtactaaaatgctcaggaaaatcaaaacataattgtagcttctgaataagttaatttttaaaagattacctcaaacaacaaacaacccagctcttgatataaaatctggtgacttagagattgtatgtgtgtgtatgtgcatgtatgtgtgtacacacaaaacacatgttttgttgtttggagtttttctttccatttttattttaggtttgggggtacatttgaaggtttgttacatagataaacacgtgtcactgggattcgttgtacacgctattacatcactaatgtattaagtccagtcctcaatagttatttttcttctccgcttcctcctcccaccctccttcctcaagtagaccccagtatctgttgtttccttctttgtgttcataagttcatatcttttagctctcacttataagtgagaatatgtggtgttgagttttctgttcctgtgttagtttgctaaggatggtaacctccagccccatccatgttcccacaaaagacatgatcttgtccttttttatggctgcataatatttcgtggtgtatatgtaccacattttctttatccagtctgtcattgatgggcatttaggttgattccatgtatttgcttttgctgggtcgaatggtagttctgcttttagctctttgagaaaacaccatactgctttccacaatgattgaactaatttacactgccaccaacaacgcataagggtttctctttctccccaatctccccagcatctgttattttttgactttttaataatagccattctgactggtgtgagatggtatctcattgtggttttgatttgcatttctctattgatcagtgatattgagctttttttcatataattgttggctgcatgtatgtcttcttttgagaagtgtctgttcatgtcctttgtgtttggtttttttttttaaataaaaatttcattccagtgtaccaaattaaaattgccaccagtaaatactttaagcatcctttcctgtgtatgagattaggccctttttaccatattttttaaatcttataaatagtctcagagggcttttaatgtaaaataatgattgaaggtcaatcaatccttgtcagctaatgatatgtttctaggtacttttccctttcctcaacatttttatcaacacaattcttatgtaaatgagttctatttaaacagtttagtctggtttagtaaggtatcctgtagaaaggaagaatgtgtcaactctggaagtttagcacaaccctattcttttaaaataacaaatagtgaaacacttcctttttttttttatgaaaactgttttcatgttgcagggttttacccatcttcaagtaaaataatctttcaggaattaggcccaacatgtctctctacataaacaagattgatgttggctcttgaagtttttcgagagtatgttgtttgagttaattgaatttattgtctccaaattggttttcacacttctctagtgcagtctgtattctgttaattaaatttatgaaactcgtgtctcacattgaaagaatataatacagatagataactagactcccagatagacagctagttatagacaaattttttagcctcctcagtagctgggattacaggtgcttaccaccatgcccagctaatttttttattttttagtagagatggggttttgccatgttggccaggctaggcttgaacacctgacctcaggtgatccacccgcctcggcctcccaaagtgctgggattacaggcgtgagccaccgcgcccagccgagtttgacttttttaaactgcacattataagttagatcatgcagtatttatctttctgtgcctggcttttttcttttaacataatatcctctagggccatccatgtttttacaaataacaagattcccttctttttaaaggctgaatagtattccattgtctttatatgccatattatctttatccacacatctgttgatggacacttaggttgatttcttggctattgttaatgctgcagtgagtatgggagtgaagacatctcttcaacgtattgattttatatcctttgaatatataccccatagtggaattactggattatatggtagttctattttttaaattattgaggcactgtcacactattttccataatggctgtagtaatttacattcccaccagtagtgtaccagggttcccttttctccacatcctcaccacttatcttttgtgttttagatagtagttgttctaacaagtgtgaagtgatattttattgtagccttaatttgcattttcctgatgattagttatgttgaacattttttcatacacctgttggccatttgtatgtctgctgttgacaaatgtctattcaggtcctttgtccattttttaatcaggttatttgttttcttactgttgagttgtttgtttcttatatattttgcgtattaacctattatcagatgtatggtttgcaaatatattctctcattctctaggttgtctcttcactctgttgattgtttccttttttgagcagaagcttttaagtttcatgtaatctcatctatttttgcttttgttgtctgatcttttgggtgtcatatttaaaaattcattgctcagacctatgtcaaggagctttctccccgtgttttcttctagtagttttacagttttaaatcttacatttaagtctttaatctattttgagttgatttttatatgtagtgtaatatgaatgtctaatttcattcttctgcatgtgaatatccagtttttctggcaccacttactgaagagactctctttttcctccttatgtattcttggcatctttgttgaaaattagttgaccataaatgtatgtatttgtttctaggctctcagttctcttctattggtctgtgaatctgacaatatgccagtaactctgctgttttgattactatacctttgtaatagaatttgaaatcagatagtgtgatgctttcagctttgttctctttgctcaagattgctctagctgtttgaggttccatacacattttagtatttcatggttgcatacaaattttagtattgttttttctatttctgtgaaaaaaaatactgttagaattttggtagggattgcatagaatcagtagatcactttcattagtatgaacttaattaaacaacattaattcttccaatccatgaacagaggatatatttccatttatttgtgttgtcttcaatttcttttatcaatgttttatagaattcaatgtacatatctttcatctctttgctcaaatttattcctttttgtagttattgtgaattagattgttttctggatttttttcatatactctgttgttagtatattgaaatactactgatttttgtatgctgattttgtatcctgcaactttactaaatttgtttattagcagaactatattcttaatcatctcgattatattcaccataaagagtaaaacaagaataaacttgcttcactgtaaaatacttataatctaaaggaatcgactcatatgtttatatttgctacaaatggatttttctaaattacaacaacataaaagccaatttaatgtttttgtagagatattattcttaagagggtagaattgcatgaattctgacctttggggaagatcttgtatgataatggtttagattaaatattggccaattctctcaaattcttgtgtgagatatttagaagttaattacttaaaaatctggtaacaggtatattgttttgttttatattctctatttaaaagaaactttgaatgcatttttaattaacctctatagatatatacaagttgtacatggtcctttcagccattttcctacattgtaccagaattattagaacaaaactggatatcccatgcaaaatttaaaagttggacccttaccttacaccatatgcaaaacttaaaatggatcaaagacctaaatgtaagagctaaagctatgaaactcttagaagaacatgtaggagaaaaactttcatgacattggatttgccaacaatttttttggatatgacacaaaagcacaagcaacaaaagaaaaaatagatacattgaacctcatcaaaattaaaaaccttttatgcatcaaaggacacaatcaagagagtaaaaatatgggctaggcacagtggctcaggcctctaatcacagcactttgggaggcagaggtgggagaatcacttgaggtcaggagtttgagaccagcctgggaaacatagcaagaccctgtctctacaaaaagaaaaattaatgaaaagataacctatagaataggagaaaatatttgcaaattatacatctagtaaggggttaatatccggaatatataaagaacttctgtaacttaacaacaacaaaaaagcaattaaaaaatgagtaaaaggcttgaataaacatttcttcaaagaagatatacaaatgaccaataagcccatagaaagacactcaacattactcatcattagagaaatacacatcaaaccaccgtgaaatagtacttcacacccactaaagtgactattataaaaacaaaacaaacaaacaaacaaaagatggaaagtaacaagtgttggccaggatatagagaagttggaactcatgtaggttgctggtgggaatgtaaaatggcacagcagctgtgtaaaaaagttttgtgattccttgcacagttaaacatagaattaccgtatgatctagcaatttaacttctcagtatataccaaaaagaattgaaagcagggactcaaacagatacttaacaatgtttatagcagcattattcaaaatagccaaaaggtggaaacaacacaaatgtccatcaacagataaatgcataaacaaattgtagcctgtacatacgatgcaatattacacagcttaaaaatgtaatgaaattctgacacatgccacaacatggatgaaccttgaaaacattaggctaagagaaataagctagacccaaaagcacaaatattgaatggttccacttatatgaaataattagaataggcaaattcatagggaaagacagtagagtgacagttaccaggtgctggaggagagggggaatggatagttttggggtacagagttctgtttggaatgaccaggagttctgaaaatggtcacacaacattatggttaatgccactgaattgtgcccttaagaattttttaaggagtaaatttcatcgtgtgtgtattttgccacaattttaaaaacatcacttttccataaaaaaataactagagacccctgaacatacactgtggacagattttattaataaatcttatggtttaagtatcaagctattgttaattacttctcctaagtaaataaacctaatacctggtaaaatgatgtctagttatgtggttgcagtatattaaccaaggaggactcgttgttttgaagcaataataattataactaatgtttattgggtacctagtgtgtacctgacactgttatgttcttcaactattttagctctttaattttacatcaatactattagatacttgttttagccattttatagattaggacactgaagttcagagaagttaagttattcttctgagtcacacagctaaatagctaagtatcaaagacagttgttctaacataaggtgactaacttccatgcttgtcattttaaccaatttcaaatttcatccatatttgctttgagatacctgaaaaatcagactattttatatagttttataagaattataaagcttagaaatgtaaaattttatgtggggatctaagatttccccctgtataacaggatcatagatgtcagatcaaaagatctcagctggccgggtgcagtggctcacacctgtaatccctgcactttgggaggctgcggcaggcagatcagctgaggtcaggagatcgagagcagcctgggcaacatggtgaaaccccgtctctactgaaaatacaaaaattagccaggcttggtggcgggtgcctgtaatcccagctactgggtaggctgaggcaggagaattgcttgaacccaggaggcagaggttacagtgagccaagattgcaccactgtgctacagcctgggtgacagagcgagactccatctcaaaaaaaaaaaaaaaaaggaaaagaaaagaaaaaaaagatctcagttgttatgtttggggtctgaacatgtataatgttcacggcttgactctagtctgcttttttggttgtttgatctcagtgttagtgcatctgattttttttaagtaattcagtcagtagacgtttattgcatgcctgctatatgcatatactctgccaagtcctggaatacagtaatggacaagacagaactgacattgtagtagttgaaggaggaggggatggataatgagtaaatgaccaaagaaacccagcaaatcattttagttctagtgctatgaagaaaacagggtgatatttggtgcgtaactaggggctgatggctgatttagagggtgatcgggaatggttgctatgatgtttcaggagaagaacctaaatgttgagaagatctgtgagtagatattccactcagtgtgaacaatgggtacagccctgagaaaatgtggcttcaatgaggagcagaacaaaggccagtgtggcatgaaacatcccaagtcctagggtgcaaggatatgaaataatacatgagataggtgtgggccagagctcaaaggccttgtaggccagaaagaggaatttagatattatgctgtgtgttctagaaaggtgttggaagatttaaagatcggaaatatgaaataatccgatttcattatacaaagctctctcttgctgcagtgtggcaagggattataggagggcagaatggaagtggaggaaaatggatattggaggagtcaaagaaaaaaaatgacaatgatttgggcataggtgagagcagtagaggagaaaacttatgtttcatcttcaaaaggtaaattggacttttaaaaatgactgaactctacacatatattgcaaaagtacaaagaattgaacattcagagctttaggaagatacatggtttttaaaagaaggggattcctgctctttgaactggaccagtattactaagctgattcacagtcagaaaacagtctcttttgctactttccattgtgaaaaagggagagacgtttcttctcttcagccttccccctttagcatgaaactctcctattcttagtggcaactgaagataatattgaaaagaaaaaataataacttcacagaataaataatagaaagtaaaacattttacaatgatgaaaatatgtagaaattctgattgttattttagaatatcaaataacaccacaaaatcttccaaaagtgcatctaaactctgaactcattaatagcctctactaattttttttctattctgtaggaaagcagactgttgagttcagaaaaggccaggaaagtgaatttatcctagttttctgtcttttctccatgtttcaacattcccaaaagtgatttaaacctcaaattaaggtgattctgtcatctgggtggcaaagattatgatctatggcatcttatcttgcacacgtgtgttcaattattcgttttttttgtgtgacttcttttttttttttttttgagacagagtctcactgtgtctcccaggctggagtgcagtggcatgatctcggctcactgcaacctctgcctcccggggtcgagcgattctcctacctcaacctcctgagtagctgggattaccggcatgcaccaccacgcccagctgatttttgtatttttggtagagacggggtttcaccatgtgggccaggctgttcttgaactcctggcctcaactgatccacccgccttggcctcccaaagtgctgggattacaggcgtgagccaccatggccagccttttttttgacttctgcgtgaaagtaactcttctaagcatttggcagccaaaatagagaggtattgtacagccctttgaataagccctctttaatttgttgtaatgggtaaatttataggatcatggccacccagcttcacttctaatcaccaaccccctaccttgcctgttctctttcacaaaccaatacactgtggtgctggctgaaaacatttctaatcatagacttatctgcagctggtgactatttgtggtctgacaggagattgaccacatcctgtggttaaatgttattattttttctgaagactctttgaactgacttaactgctttcatttgatgtttcaactgacttatctgtagtaatagccaagcatgtatgctttgaaaatttgaattgatatcctttatgtatcacatggatatctgttatatccgttgatgtcctattacattttgtattttctgagtattttttaaaatttaggggccatcatattcctcatctaatataggctctaatacatggacacttggtatatacttgttaaaagaataaatatgcaaatgactagaagaataggagttttaaatcctccttttaaaggaaaatgttaataataaaaaatacccgtagttccacttcccttttttaactgatttcatattgcatcttccctttcgcatactgttcaattcaattaatgttgattgagctgctaatatgtctcaggcaatgtgttaggctcatgttaggttcaagggataccaaaaataagtaagacatggtccttgcctttccttatcttgaggtttagtaggagatatgggtatataagcagatggtctcggtgtgaaatttaaatcaaacaagcacagtatgctgtgaaagcacagtgggtggatttcagagaagtatttctggaggaaacttgggctctttcttgaagaatgtataagctcatggaaaattaaatcaagattgcctagctaggcgttaccagcaaggaattacattaaaaatgcttggtgaaataggcaactaaccaaagttcaaggtaattggtgtggaattaaaaagggagagagctcagtaagagtgtgccacgttatggaggtccatgcatgtcatggtaaaggcctgaaactatgtactctaggccaatcagtgttagctttccaaggaggaggtcactgataccttgaaactgagctttaagtatgcgtatgcaaatgaacctagtaaaattgcttcagtataaaaactcttaatatagggaacattttataaatggaaaagtagacatttaatagtcacaaatgagagtttaaaagaaactagttatctccatcaagagtctctatttcatagattctctaaggattttttaaattctaggttagcttccttcaacactatcagtctgtaatatttttcactaagttccctcttccccttttctgaagcttcctaccattaaaatttgcttaagtgaaacataaatctcgacatgaagtatatttgggtgggataggatactgtgccgaagttgtttatttgtactgttcttaacacaatagttgagtacagatacactccagacttgaataatgtggctaaatagatagtctccaggtgatcaactaaaaataattgtattctgtcatcacttctcccattgatcccaagaagtgcctccaagaaaattacctttccttctccagtattagaaatctgtgggatagcaccatccaccaaactacccattgaaccactatcttagagttggaaacactgaaacatcctcatttccttcttagggtccagcaaaatggttcagtaccttggcaacacgcccttccctatagaaccagagggagggagtggggaaagaaaatataggaagaaccaaaagtgaggattctatgagagacaaagtgaaagaaagctctcaatgaaagaaaacccacacattaaatggctttcagtacccagatctagagtgcctggtttgcattgtagtaacttaacatttgtcagtaatgatgcctacaaatactgtgtttattatgtgtgtaagaatgcattttattttgtttttttgtttttttgagatggagttttgcttttgtcattcaggctggagtgcaatggcgtgatctcggctcactgcaacctccacctaccaggttcaagcaattgtcctgcctcagcctcctgagcagctgagattacaggcacccaccaccaggcccagctaacttttgtatttttagtagagacagggtttcaccatgttggctagcctggcctcgaactcctgagtgtatctacctgccttggcctcccaaaagagctgggattacaggtgtgagccactgtgcccggccagaatgcattttatttttaagtccacagctaaagattatcttgttgtattgttgaatagtgacaaagctactactaagtgtgaataaagagtttgtaattttgcaggcattcattaaattaaataaagccatatatgcctataaacctaataatcttctttaaaaaacaatttattgaaccaaactattaaaccaagtttcagtaaattagttgcctaacacttgcacataaaaagcaacaaatgttttttgattcaatgaacaattgattattaaaatcaagcacatttgtcttactgaactgttagaattattaaaaatggaagcaatgtaaggctgtatagatctttgtaggctgcagttaagtataaatctgttgctccttctttcgtatgttagcctgaaaaagaaaaaagcatgcacttagaaatcacatggggaaattttataatttagatgatttgacagatgataagctgtctcaaatccctttaagaagatagtgtagtataagtaacacacaaatacatgaataagtgaataatttttaaattgacaataatttgaatgatctagacttacctcaatctctgtattctaaataggcattgtgcttagaaaatgagtataaataagattttagataattacttaacacagtaatttgcatgtggcatgcctctgcttggctgtttcttaatggagctctggcagaatttataatttgtaaaggagtcaaataagactttatcaccttttacttaaaagaaatgtgttttcatttccttagaaaaatattccataatttagaaatatggctattcagactagactcttttcagattaaattgaattatgcagctttacagtgatgctttttcttttaattcattgaacattttatatccagtaaaaagtcagctaaaattactagagcaaatcaggcttttctttaatgcttactaagtgggcgtgtatgcttgtgtttacacgtgtatgcaggcacacatacaataaaccatttggtaatattccagagacccaactatattgccagtaaaaaataagaaatctgttgtctgatgatatgtgtagtacatggcaacagaacacttaagctgaagcatgaagaacttgtgagcatgaatgttaaacctagaaacaattactaagtcacttcttagctactgacaaaatcaaaaggttgggaataaaaccggcaataactcttgatctttttttaaaaaatggtattactatctcagacatcccttcagaaagcatcgtttctgttaagcctgtgtagagattaatctggcattatctttttaaaaatgtctagattgacttaagcctttattcagataaatgggaaaattttatgtaactagaaatgagctactagttttcattgtaaaacacagtcactagagtataccaaaaagaatgttgagcacatttgggaaaaggtagcttttgtaagcctttttatttgtttttaagagacagggtctagccctgtctcccaggctgaagtgcagtggtgtgatcgtagctcactacaacctctaccctctgggctctagcaatccttctccctaagcctcttgagtagctgagattacaggcatgcccaggcatgtccagctaatttttaaattttttatagatacggggtctcactatgttgcccagactgaattcctgggctcaagtgatcctcctgccttggcctcccaaaatgctgaggttacaagcctgagccaccacacctatcttgtaagtccctgtagtaataaaatatatcctgaatattgtgaggaatgagaggaaagttagagatcaaataaggggaaattgagattcctgtttccaactcttttgttccttttttctctcctctttgcagttgaactcctgtttcttcctaggtgttcatgtctcacatttcttcctggccaactcttcctcatttatgtagggtcctccttggatagcacctcctctatgaaagtttctctgacccacagaaggaattcattattctctcctctcttttcccttagcctttatgagactattttttcctcttcattttttgcttatcctttgtatggagtaacttcctgaatctatatagcagtggtgtggagccctctaggaagcataggaaataggggaaatagcaagaattcttcataaactgcaataagtgacaagatgcagcaagactcccagccttcctggctggcatggggcactgattggtgtaatgttccagtgtggatgttactgtgtattcatcagtgagtctacacagatagagtccacatgtgtcccagttgtgctaattcttcttcctttcatcatgctaaaaaggtaagtattgggtgaaacttttttacttacaagtatacatatttcctctgtaaatgggacaattcctgagtctaggatttgctaggtcttaaggattatggctttaaaaatagacctatgctttaaagcatgttccacaggaacataattttttatttatgtttctattttctccacgagactagatgcttgatagagcttacaacttgattctttatattcttgtccattagcatgggcaaagctcacacatattatgaataaagttgagtaatatttgtagaattagtagataaacgacactgcttaatgacaaagtttaactctccatgaagctatttgtattttcaggaaaaaaaaaaaaatgctgtgagaacaaatgagtcgctcactggagaacttggtaggggatgtcctggtatccgcaaaacaagaaggaccatttaaatagctttcagccgactgtagcctgagcccttcctttgtaagcatctacacactcacagggatcaacagtaacagtatctcctctccagcagaggatctgttggtcttctgagtattgaagactgataaatgatagaatctcttcttgtctgacatctttgaaacccccaatgttccagaacctggaaaacctgttgtcgtataggggcgtatcaacaaatcagtggcttcactcatctgtcacctctatttcaggattatttctgaagtattgatgattagaaatatgttagaatctgaactttggggtataaattcacccattatctacagtagctttcctgctttcataacatgatctacacattttgtggctaaataaatgctcatttttctgatgaccaaagctaacttttagatgaattactgatacacagaaacgatttcatcccaattaacgtgtgaaacacaatttaactgtgatgatgttttcagtcaaaggcagttgccttggcattaacagtgaaatcttacatgcacaggaaggttcagcctaaccctggtaggattcctaggctgtttcagtacatgtgacgttaataatatgtagcttatcaggtaatgatgctcagttagtaacattcttcagtgagccaatggcagatatttttaaaagtgattataatttttctctaaggattacccaagcataataaataacaaaatatgagcaaaaaatgtgataatacaagggatttttaaatggcaatgattttaacatatagataaataaaaataatcatgtccatattatagtgtttgaaacttagtctagtgaatgacaagagatagcataggtattgagattttaatttatctgataggcttaccgaattccaatagttaatacataattcctctgtgtattcaaattgtttctaattagatggacttctctattcttttaaaatatattttgtaaatattcttgttatctttagaatgtctgtggtgcttgcaaaaccatatacagcgatttctttcatttgtttttttttaatgcacagtagagtatataggtcagataacgtttgaaatgcatgacatgttagtaatcttccatttacctctttaaattaatattcgattttagtatttatttatttttgagacagggtctcgctctgtcatctaggctggagtgcagtggtacgatcatggctctctgcagcctcagcctcgcaggctcaagcgatcctcccacttcagcttcctgggtagctgggactacaggttcataccaccccacctggcaggctctcactatgttacctaggctgtttttgaactcctaggctcaagcagtcctcccatctcagcctcccaaagtgcagggagtataggcgtgagccaccacacccggcaaaatcagtattttataagtgaaattacatatatatatacacacatgacatagtagtgtatgtgtgtgtatatgtatgtattacagttgttcctcactatccacagaagattgaatcgaggaccctctcagataacaaaatctgcagatactgaagtccctgatataaaatggcataatactgtatttgcctataacctatgcacatcctcctgtatacttatttatttttgaatactatatttttgatcctcagttggttgaatctgccattgtcaaatcctcatatacagagggccaactgcatatataatttaatgatagcaaattactaaaaatatcgaggccataataaaaattattgatagcaaattactaaaaatattggggccaataaaaattaatgacttcaagaattaaaaacagttactatacatatatgaaaattaactcttaaaaatgtgacttggttattcagttagcttggatagatgaagcagaaagttaaatggtgattatgaaaactgaacttttgtatatgtggtttaactacattgtgagttacgtgagtgtgttatttctccttttgtctcactactttaatgggagattattgttgcccaactctgggtctagtatgtaaccaactcttttcagccagattcctcacctccaaaagagtgtcttgcatctttgggtctgggcccaggttcaactccaagaactgtacatctcagggaccaaaggttatgcttggcagggaagcctaatgccccatcagggcactcactaatctatctgagtagactattagtgtttttctatttttaaaatgtgttttatatatgcacaggtactctggtatcagctgttgtgttttccaaagagttgagtgcattattatatcaactcatccatgctcataatatacgtatatgtgcccaggggaattttggggagctaagggtaggactggtgcaaaactatgcagttacaaattataggcttctgaagaggtaatctgactcagtaaaccagcctcaaatcaaaaaagataagtactatggtaagacataagagctaatctgcaaaacacagcttgcacagccctgaattcattattaagatttccataaagacatagaaaggatgctataaatgactgtcacctcacagacactgcagaaagaccacttactttcaaatttgacattctccttctccatgagtgttcttgggaattcccggaagagagacaagcatgtgaaaaggccctagggcaggaaggagcttactatgcttgaggaactggaggaaggccatcacaactagagcaagaaagagagggcctcaattggaagataggtgggatacaaattaagcggagacatgaaggtcatatcaggagttggcctgaaaaatcagtgtacagccattgaagagcttcatgcagacatgtgacaaaattggatgtacatttaaagctattgtgtggagagttgatatgggggctggggggcaagataggaaatggggcccattaggagttattgcagtggtacatgtgagagatagcagagacttaggctggtgacattgtagtggagatagaagtcttgattcaagtcctgttttggagatataatcagcaagatttagttagagatctgtacctacataatagaaaaagtggttgggcctcttcaccctgaggtactagctcaaataacaggtcaaaccagaaaatcatgaagtggtgcttatagtttcattcccccatttaattatttaatcacttattcactcagaaaacatttattaagctcttcctgtgagccaggcattgtgtaaggtgctgaagagacaatgtcccattatcggtcatgtgctctgcctgacagacccttacaccagtggttggcttgatttactttatatcttagaacatggtgctaaggagacccacatttttcattgtatccccatagactttgttcatttagacacatggttcccttcaggggtctttggggagcccctggggtaactagaaatggatggacttggcacactggttggcacgctgacaaggtagttctgccgcacctagaacagggcctggtgctgacagtcttgccttatacaggacatctgcacactcgtaatatagaatcatccagccaagacacccagtaacactcctactaatgagccctgatcagcttcacactgaccagtgactactctcctgccctcaccagtactcaaactgtctgactttaatcaatgattaaagggcacataagtgggaattctttatgtctgtattcttcccagtctttctgcatgatcctttggggtattccgagccccttgtcttacccttctctgctccccaaattgtgtccaaggggcaagctagtagggcagcacagacaagaaaaagctagtccttttcctttcttttgtgtgtgttcttgggaaatgaccttaatctccattactttcatttccttgtctataaaacagaaatagcactagtatctacttcatagggttgctgtgttgcaatctctagagcacttagaacagcacttagtcttggcacattttcttagtcttttgggctgcttaacagaataccatagcttgggtggcttgaacaacagacatttctcacagtcctgaaggctggaagtctgatatcagcgtatcagcgtgccagcgtggtctggttctggcaagggctctttcctggattgcaggctactgactttttcttatatctctacacggagaaaagagaggagagagctctctggagtccctttggtaacgaccccaaatgagggctccaccctcatgacctcattacctcccacaggccccacctcctaatatcagcactttgggagttaggattttaacctattaattggggagggggcacagatatccaggtagttgcacacacaataagcacccaatgaatatttattgttattgttattgttcaacaagtggaagacagtgtgttggatgaccatgcaggtgacgcggatgaatctgtcaccattacaacttctgccttcatcactaaatgaagagataccaattgcttaaatgcaaggcagcaggagatatgtttttttacaaataaaaatctgattgtggtgattcttcgcttaactgcttaatgaacctctgttaccactgctcaaacgcttggatttcaggtctggcaatctcatctcactaggtttgttcttcagctttaagttaatttcccaggggaaattactcctttttccagagttagtcccagtcctaccttagcaagattgcctcctacttgtgcattaactgggtgccgctcttggttcctgtttcccatcagctccaacctgaagttcctggctttcccccaccacctcgagcactgcttttaatctccaagtcagtgctattccttgggttaatgtggcaccattttattttttaaatcccagtctttgactctacttgctgctcagcctcatggtcaaagatctattactgatgaaattttacaaatgttgtattctggatgaaattaattttgaccatttctgatgggaattgcaaattgtacactagaaacagaagaacaatttattatacagggtaataatacagtgtgaatcaacatcactataaataacaacagtaacaaatatttatctttctgatacatatctcattttttcatgttctagagttatctttttttttccttgtgagccctaatgttctggagatttcataaatggtaattaatgcttcaaatttataattgatatccttcatatcatagtagaactctgacatcaatttattcacaaaatctctaattagttaattaacaatttattcatgagactgatttaatttgggcattatatgaaatttcacaaagcacagtaaaaattttcaaaaatatctaataactatggcttaattttgtgttctattaaaaaataatgtgagtataaaaatatgttaaagttagaaaattcagtagcttctcttcaagacattgaattctattataactgatattttttccttttcagacatttatcatacatatagaagaaatgataaaatggtttcatttgtgtaaagatatttttaaataatgggacgaatgaatactaggagagagaatgttgtcagacacagttaactacataatctaaaactcaacatgaaactctacacccctcaaatttgtctaaagctattatgatttattgaaaactaccagaatgctagtccccctgactttttaaatattctcctttaaatacgaaccccttaggaaataaaatctattgccatgtatagctaaactttggtatttgtatgattttttttaagctcatgtaaagttcagatttacagtaaatgaaatggatagcatgattctctaactgggttaattcatttaatcattacttcaagagtcattaattaagcaaatatgtattaatgctaggttagatgctaacataacaaagatcagtaagttgagagcccagtgatccaggatctggtatttttcataggccaaataacatgtttaaggagcctataaatagcagcaattttattaatgtcagtagactttaatcaatgtttattaaacattttaacaatccaaaattgtctgtaatgtatgtaggttttctaggtacttatagtcaaaaacaaggataactacgagtatatattatatctataatacatcagtcacattcaaaggaagaaatctcacaaaattgttatcgtcactatacaggcaacagtagacttgttgaaagtgttttttgtctaactattttgcattgtaatttatgtaaggtacattgtgtgattgccttattatagattctaatcggaataaatagctatgctattaaatggaattacgtacatgtaaccatggtttttagaacatgcctatatgaagatttatatgataatcttaggtaaacattttatatgtgaaaataatagaattggaaataatgacggacgttaaaggactttgaggtatccagaatgcaattaagagaggcagaagttgcataaatgttcagacatgtttataatttttagcatcccatcttttccttttggaaaggagaataagggagagaatactaactggtgatctctaaaacatgctatcctttgatgatgtttcagaacttaataaagcaaaaaagcaaacaagtgaacaaaaagaaaaactaatttagcatccttttatctcactctatagtattcatacatgaagctctatacctttacttgatgcttttccaaatgactcatgccttctaaactggaaagactggcagtgtcattattggaaaatctgcactgtggagtggttgagggcatgagctgtggagtggatggcctgcctgtgtcactaaacgctgtgtgatcttgggcaagttacttaacttctctgggcctccattttctcatcaataaactgggaggggaattgctcggcgggcaattgtgaggatttataagttaatataaagcttagtacactgtgtggtttattgtaagaactcagcaaatgttagctcttacaaggttaaaccccaaagatgaaatgtccttttaaaatcaagccagatcatagcagaggaagaaatggttgataaatgagaaaatgatctacctcgctaataaccaagaaattcatattaacttttccacaattgaataggtgttctgtatttattaataataactattattagtaatgatttgggtctgtgagcaccttcacaattttcagggtgcaaccattttggaaggtgatttgccctgtctgctctacaaaattttaaatgtgggtactctttcacccagtaattttacttgtaagaatttctctttcagagataccctctaatatgcacatacacgtgtgtgcacgcatgtatgtacgcatatgcatatctctattaattgctatgttacgttaaattaggggaaaatgcttctgatatgacatggtgcccataatttcatgtaaaatgacaaatacaattaacttaattatttacatatagcacgtgatcccacttttgtgggaaaagcatctatttttatgtgtgtgttttcaaggggaaaaatacatgtttaaggatgcacacatgcaaaaatagcaaaaggatacatggaaactcatactcaatagctatgatgtgtatcatctccttttgttcagaaagtgtttctaaactgtgccaaaattttgtcagatatcattaatatttgaaaaattgaaatgaaaaccattttctgcgaaagatattgcctactatatttatggcatacagaaaattgtgacctcatgtgtctaatgatagacaaataaaaaagataaaaatgtttagtgtagtatagatttgacttacgaacactgtctcatgttttaaaaagttttgattttttttaaatcatctaagaaaaacagctatatgaacacatttgcaaatctattgatgcttatttttttttgcttctttttaaaagtgattatgttttttatcttcccagagttactggaggtgaactgtttgaagacatagtggcaagagaatactacagtgaagctgatgccaggtaagtgacttgccctgggcaagatacaagactcaacattcaaataatactttttcagcatatttctttacaaatgcatgtttgtacaaacaaatgttttaaggatctccgggatgattcttagagaaaaaaaactccatgaatctggtctatatttttatctagcatctgtagttagattacatattttatcaaaaacaacaaggaaaaacaaaccaaaacaccccacctaattggaatgacttctgctaaagcaatatattttttagtgaaagtcagagatcaaagattgaaatcctctaatccctagatagattctaggttgcccagtggtagccagtagtcacatgtggctattgcaatttcaattaattaaaattaaattaaattaaaaatttatttctcagttggtctaaccatgtagttggtctagccaactgcctagtagccacaagtgtctagtagctaccaattggccagaccagatatagaacattttcatcatcacagaaagttctactgaacaatgaatatctaatcagaaaacagaaacagcctgaaaaaagtctcagtggtctctttaaggaactattattagctaattaactctttggaaatttcattaaaacccttgaacccctgagttgaaatatatttattcaggcatttaagagagttcaagagtaatttttcaatcttgttaattggcaaaatctttacaaaagtttaaaaaaggctaagttttttgtctaatttgcaacttcctaggctatccaaggcaacacttttggagtggagtaacattaaccacttgcttagatgttactggattgcatggtgtaaattttcctgtgtacttttatatattctgtagctgtcatttatttttaaaaatctgatcaagagtgattggctcattattagcaatgtaaatgagatgtttgggagcagagattgactctgctcccattctccaatgccatcagagcttcccaaggcttgctaatcccattgtagcctgaccctcaacagatgtccagctgatattaaggttcccagcccctccttgccctcagaggcacacttctaagtttctaatttttcttcttggtttaatgcactgtttatggcactttgtgaatctatctgtacatgactacgctctaattttttaatggaatttttatggccaaagtcaaatagaaaattctgtgtaatttatactatgatgagtgaatcatcacttgctcagtttaccccaaatccccacattagggtcctgaaaggggccatggggaacctctggaagtagctatttggccacttgccaagaaacagtaatacttttaatcaaggtactaaactagggaatttcattaatgttacccttcaaagttatgttaagcaggctgttacttggtttgaaaaatactggttgaaattaaaatagagactatttttactgctaaagagctctaagatattttttatgaaagctctccgataaaatcaaagagaaggaacattcccttctaaatacataaagaggctatttctcagtcagatgtggtggcccactcctataatcccagaactttgggaggccaaggtgggaggattgcttgagcccaggagttcgagaccagcctgggcaacatggtgaaaccctgtctctgctgaaaatacaaaacttagccaggtgtggcagcatgcacctgtagtcccagataatcaggaggctgaggcaggagaatcacttgaacctgggaggtggaggctgcagagatcatgccactgcactccagcctgggcgacagagtgagaccctgtctcaaaagaggctatttgattgtcaaaaaattgtaaaaattttttactagttctcaaaaatttaagaattgaatccattctcactagtaaaaaaaatggtgaagtccatttagtatgtgttattgtttacttctttatcttctgttattcccaagattcaataatttatgcttgttgtttgagaacaggaagagaaatattcttaaagagtagtgcaaagtgaacattattgtaaaagaaaaaagattcctatggtttaaaaataatgaccaatactcaaataaacaatgtagtcaacagcaatgaatgtgagacgcttttagtggtattgttaataaaagagctagaaaatcatagtcatgatcaatttttaaaatatttacattgtaataaatcagatggtgattacttttttaaattcaagatttttctttagaataatattattttatacattaagtggttgaaaatgtccttattaaaatgtttgcttcatctttcaatgaataaatgtagttcaggatgtacttgcatttgaattgcacagtgaacttatacaaaattcatcagtgtgatgtgttctgcattattatatgtcagatgacagttcacaggaccttataggtgccaaacaaggatttctcctctctaattagcagtcccatttgatatcagtgaacccttaataagaatagcataaaatgtgcattttgatatagtatgaagcaaaagtttttcttcactgaagtgtatggaagtgggtttaataattaccaatgctccaggggattgtaaatttgtatttatttattctttgaaagctccctagctcttccccaaagtattcttacactaaagaggggtttattttattcatgagtttactttaaattctccctttattgttggagacttgcatttgttttcctgttatatactttacaaaaagcaacgcttctaaggcgaaatggtaaatgtgtccctccattttttttgacccttgtttcacctgccacttcatctgtgtttaccctcttgtttcaacacctgtttaattgtgacctcagattttaaacagtttagatgtgtataagaaatacctggaaattttatatctctgaagaattttcccagaacattatgggaattctttataaatttttctttctaaatatggagattttaccttcttatacatattatttaatttgtacacttacaatgaaaacaacacaactcaaattgttttgtctgaacatgtcacaaagtctatgttggatgtcatttttgttagaaccaaaattagctttattcagctttatttgattccaacgtaaagctaaaaaaagtgaagaaatataatttttgtttgtttgtttgtttcattgggactttcattttatttcatattcaatgtgattatgtgcctttaaaatgttctcccttccattctgcccttgtatctttgcagtcattgtatacagcagattctagaaagtgttaatcattgtcacctaaatggcatagttcacagggacctgaaggtcagtatatggagtccataaatctgaatcaaagcagttttatttttttttctggggaaagggcagagggtgggtatttaaaatggttcccttgcctttcccaacttgtttctaaaatgagtaaatgatgaaatgataatgcatgatgcctcttccagtttgctcatctacaggctaaatatacatcatagcaaaaagggaagaatactaaagaatacaacctgctaagtttccaagcagtaaactacctaccaaaagggattgaggagcaggctttcttgaattgcccagcatttgcctggagataaacttggcctgtgatgtatgtccgcctgtagattttaaacaccacttctgttctgagaccatgggttgctgtagcagaacaactggttacgcattgctccatttgagtctgatgaacccttaggcaagagatattaattgccagctaaattaaagcacaagaagttaatgatttatcaaaaattcattaggtatcttaatttaaccttagtggtgccctgactgttaatgtgacagcttttagaacaatactggaaaaatgggagagaaaagggaaacaatttatgtgacggggtggaggcggaacaccacagctataaagattatatttgtgttccactttatttcctggaagaatttataaccaggaaatgatctcttgaatgacataaagtgttttcaaaatggatttttctagaacaaatggacccacattctggctcacatctggtaagatctgattgttctgaggtagtagtcactctacttgagcaatatgtttacatgactgaaggtggtacaatacaaccccagttgtctgctagctctgcactttaacccagtctctctgagggtatacagacagtgagtgtaagcttggaactaacacacgccccctggtgtttgcatgcagtcattgcattcagcagatcctggaggctgtgctacactgccatcagatgggcgtggtccatcgggacctgaaggtgagtaatgcggttgaagaagataaaccaccacacagttcctaatgactgttcagctgcaattatgcctgtaaaggcaaaaatatgagcaataaagttgtgtggacttattccagcacgttactcaggaactttccctcaccacagtctctcttatttcatctctaacacacacttgagacatataaatcttgatttatccagatagaaataacttcccaacattaacaataaataggatgctatatttctttccttgtaaggatggatatagcattaatgtgactttcagtagggtttgatgatcttcactctaaatttgttctgtgtacattgatcaaacattttatattcatgtgatatatacccaatattatgtaaatacttagtaaaattataaagtgtgtagagataaagttattaggtgaagttttagcctaaacgattatgtgctaaagaacctcattttgaattctgacattctctttcccttaacattagtcctaggaattctgaggacactgaggcctcttagttttttatttatttatattcctaaagaccaagataatagtgtcttctaaaactacagatgtaaagaaagcaaaacaaatttaatcatcaaataatatttatgtagcaaatatatatggatatccctatatacatattctcatttgaatgcctactgatacccttaagacttcactcagcttctgatacccttgaggacagagaatttttagatcatttagaaatgaaatagctcacaaggggagtactttttcattaattttccgtctccatttcccagcactctagttttacctgtggaatttcagaaaaatagtgaagcctagaaatcgaaaagaaaaactactggatgagtaaaatagtaaatgtgagcactgtatatagttttgattctttcaaactcagcattttctaggcattaggacaaaggtgacaaaggataatttagaatgtctaaaactatgtgtgtttagtgagaggacctagacttatttctcacgtgcagacttttctggttataaaaaaaattataaatccatatttccagtcacttaatgttctagaagactatatctctaaaccaattacatgaagatgtgatttataagcaaaacattgccttagttttctgcaatcttttgatttcatttaattctgagagttttaaatatcaaaagcaaaggtatggttaagggcattttcttctgaagagccaagatcggactgtatatctgctaacacttaccaaatgtacccattagtataaagcaaaagcagtgtgtttctttgaaaattcatgtattttacagtcacctcaaaaattctttactggccatttacagacagagccccttttgttacctctcagaacccacagcactactttccttttaagtgaacatatatgaacatgcacatcatttgtgcaattttttttcagacacttctataaatttattatttgaaacattttactccatgttatataaccataagtggactttaaaagccaagtattaaaaaatgtgaatcctcttccataactttaaagatattttttgtggaatcgtaatacaggacttctctaaacatctggaatcaggtgagcacttcaaagactggaactttaataggacatgggctgtgaagaaaaatatattctctgacgtatgagctaacgtcactaattaaaaacttaagcagatgatttttagggaggcttactagcaaaagaaataacttgctgcattccccaccagatttctttaaggcagggaaagtacttttgctctccattcttattctgattctgggaaaggacagaaatgagcttttgagagagcttgttataatttttttagttgttgtcttagtttgtgtcaaattgctgacttggatggatttcagttgagtctggttctcagtgcttgcttcagtaggccatttcataaacacactgagagagttcaaaacacgtgcattagaggcagttgatgaacctcttgaacgtgccaaatccctgcctttgttttgtgccttttatacccatgatgtatactctgataaatatattgcttgtgatagcatgtttaccaatatagtaaagttaaaaagatcaagtgctgaaattttttattaccaggccttaaacaaaaacttgcctttactattcctatgctatttatttttgtgtccatatactaattaatatgttaattgatgtgcgatagaaatgtttgatgcacatagtttaatttgtccacatcagtgagaaaaagaaacacaggaaatgtcatgtttatcatgatcaacagcacctataaggatataagtgctgtacaatttgtatataagccctctggaaccatagctgtttaacgtaatgcgatactccacagtacctaacgtaggggcttatacctggccaatacctgcagcatattccttcaatttagaaatgaatgaaggtcaaccaaaagtacatctataatataaaaggcagcattcagtaaaatagcttattaagtgttcattaatatttgaataacataaagaagataagtatatcttcagaataaagatcactatttagttgaataactgctgctcactggggctcattagacagtgggaaattatgaggacctataatcaagactgaggtacaacaggcaatttcaggatgtccctgaaacaagcaataggagaagagtcagggtggtgggatatcagcatcaagaaggtacatccatcggcaccaggcagaacctagtggatacatggaccacagccttttgtctgaggtgtgtccagtggcaggccaattaatgtagatctagataatattaggaggatctagtggtggtgataaacagtacagtacagttcagggataggactgcagtctttgggagcgtttggatcaagtcagggtcttaataagcaaaatggtaaaagatgccatttatcaagcagttaccatgtaccctgtgctgtcttatcatacaaatcttcagaacaactttatgaggaaggtgctctgatcatcctcatagtatgtaaacgaaaatttagcaaccacaaatgaaagaacttaagatcactcaactagtaaaatatgattggtgcctaagaaatttgattccaagtctgcatgcttaataactactacttctcaatttagttggttggatgaattaaaagcctgtaaagagaccaaagaatgagtcaaaacgataggaaaataattttgctagcaacatccacaataatttgtggaaatggttctaagtttagtgaatcaaaaggttaaaatagtcctgcctatgggtcttccagagataaacaaaatctgtgtcattgggaataaagaaaataagatataatgtagagtagggggcagtacaatctggtagtagacaggtgtatgaagtaaaactttttcatttagaaaatcagtaaggtagcattgaccacagcctttggaaaacgagacaaagaagaataaaatgcatttgccacatttaattagtaattgccacatgaagacaattagtattgggtgcttaaggcgggtggatcatgaggtcaggagatcgagaccatcccggctaacatggtgaaaccccgtcactactaaaaatacaaaaaattagcggggcgtggtggcgggcgcctatagtcccagctactcgggaggctgaggcaggagaatggcatgaacccaggaggcggagcttgcagtgagcagagatcgccccactgcattccagcctgggcaacagagcgagactctgtctcaaaaataaataaataaataaataaataaataaataaataaacttgatagatagatagattctttatgaagagctgagtgctgtaactcagtgttggatatttgtgaattggtggtttaaagttcaaatacaaaaagagaagaatgaatattcatcaaacattccttcaggaaccacgaaggcatcattttaaatgtgagcatacattactgagcaaaacaagaacagaccttgtgtgcatgaaaccctgctggccattgaattaaggatcatgtaaaaatatgtatgtaggcccggtgcagtggcttatgcctgtaatccaatcactttgggagactgaggcaagaggattgcttgaggccaggagttcaataccagcctgcgcaacatagcaagaccccccatccctacaaaaaaaaaaaaaaaatcaatatatatacatatgtgaaaagcatattgatgatgttcttcccagaaaggaggaagtacctcagacaagtactgcattcagaaaaatattaggtcaaagtgaggttgcagtaacaaatgacaatttttaatgtcacaagaaataaaggaatgtcagatcagatatattttctcatttaagaacctggagaatacaatttctatgacttagttgacagaataagtaaaggagatagttataaagctatgctttttcaaataactgtgtttgaaacaaggtagtaagatttctgcagttcaaatgtacccgaaatggttactaaactatttcatgaacaacaatctggataggaggctttatacacacaactgaatcttttagcaacaaattaacaccctatgaattgcctcggcagagaatgctgcctttactattagcccctattcagaagaacattacttaatggaaatgtcattggacggatggatagatgaatatgagagagagagaaagagagagattttaatgaagagaatttggagatgtgatgggaactttaaggctgtttcataggaataaattaaatttatgaccaaagtagaaaggaattagttttcagggaaggggggagatgagaagtacttagtaaattttttttttttttttgagacggaatctcgctctgttgcccaggctggagggcagtggcgcgatctcagctcactgcaagctccgcctccctggttcatgccattctcctgcctcagcctcccgagtagctgggactacaggcgcccgccaccatgcccgattaattttttgtatttttagtagaaacagggtttcactgtgttagccaggatggtgttgatctcctgacctcgtgatccgcccgtctcggcctcccaaagtgctgggattacacgcacgagccacagcgcccggccagtaaattcttgttaaccatgggtagtagatatatcaacctgtgaaatttatattttggataattataaaatcacaagtattatacttttctcagagctatgtttagataaaagtttaaggaacacatcatctgtgtatgtatatttagatatttttgaaacaaagtatgtatttgataaatttaataattcatttagccattccagtatttctttgttgagtgcctagtgtttgtcaggcagtggagaagctgtgggtaattggcactctcccactgcagttagttacactctggttctttcagtctacccagcagtgtgtgctgataatgtggaagtaaatgaataaacaggaatggaatacagaaggattcttatgaacttgctcatatatgcatagcaatagaaagagtacttcctaattgcaaacttatagcacatacatctgctagaaactccttgtgctaagtacatgaattcaggcattaattccacacaaaaataaaagctaaaatcccttgtaccatgtatacaaatgagacaagtgagcttgacattcaagcttttcaattcatgcaaaactaaaaaaaaaagaaatagtttatattggggagcttcatttgcaccttctttggcaaaagataagtgacagaaaacatgccaagcagaggatggttttctgttaaaagagtgagattctccaatagaggaaagaaattttaaaagacaaatttttagtccttaaaaaataatatccaaaggaatttaagaattaaataatatgggataataaaattagtaatttgctctttttataatattcaaaaatttaaaaacaagtaaaacacacatgattttacatatatattcctaatggttgagtcttttagatggcacatcttctagatgtgcacaaataaaagcctgatatggttaatgctaaaggctattgcctttgccaaatcaatttattaataaagattatgataattggtaaagcaaggttaaaactatgtttttttcataagttttggatatgggtagtaaatatttttgagtacttcaaattcttctaaaaacatctgctgaatggactaccttttaaaaataactttttatacaattggtggagcttctttagtatcacgtctttaaaaggaaggaattagaaaatctagcttcaggtctcagcttcatctttttgggcctccctacctcatgtagaaacggaaaggtttgagttattttatctcccaagtctcttccagttctgaaagtgattccatcaacctgcctatgtactttgagtcatttgaacagtttcaagaaaactttgaatcatattgaaagaaattgccattgtattcatatgaaagtacagaacaaaacttggaaacagttgctgctcattacagctgatatgctataaatggttgttgacactgagaccagatgtcatggaaaatcctgcatcattaggaagcagtgggggtggggaaggaacctatgtgtaagaatgtctgtgcactctatttaaaaaccaacctagaaagggattgcattataagaatctaaagatcctctcaatatataaagagtaacataatagattgcattaagttggcatcattaaaaaagacattcctcaagttacaaatattaaatgttctgcacattgaaatgaccagctgcactggaatgtagtagctaatcactaatgtgtatgttgtcaccacagaggacagagctcctatgataaaatccagtgtgattttattgtttcatagaaactgttgtgagatataatttagtacccttataatgttcatttgagagattaaggaactaattaattagctccaggcatttgtgagttgcccaagtccatataggtaataacagttagggccaggacatgaacccaggtcttcgcattctttctagatcatcaccctgcctgtttctcttacaatgctgtggtccatagtcagctagctacattagaagacctgggtttctgatctcacctgtctgattcgtgttagaaaatagaaaatcaaaatagtggaatagtagcaaataattgtgtagtggtgctcctgtctaaggaggtaatcattaattaggtgagaaatactaccctttcagcttgggtaaactatatttgcaaattatcttcctttctgtaggcattcagaatttaaccttgtcaacaaaattttgtagtacaatatatttttaacttggaagctatatgagtggtagtaattcaggaaaattagaataaatgtgcttgccctgattaaaatgttgctttagaaagtcttagtgattaagcctcccacacaatcacagaacatgataggaggattattcaaactaatatataccaaacagttatatagaaatcaaacttgtgtgattatttttaatgtttcattggagctgccctttaaagcaatcttgtgatgaaatattaaaaagtgaataatcccttaaactcatcatcctaaattttttagttttcattatataatttcattttagagcctaaattttagtaatcatcctaatttttacattttcgttatataattctgtattttaggtttgcctaaagatatacataaacatgaaatcatgttagtctcttaattgttacatctacacagtcaccttcaaataaccctgccttttcttctacataactgcagctgaacagtcttcatgagtataaggtgcaactctggtccagatggatttactattttctggatgactcacaaaggccctacagtgaggtcttcgttagttatgagtatttgccccagtcattcagaggatatgcatgataaaactctaagatgttccatttcttctgaatcggcagatacttggtgcttgaggcacaatgcacacaagccctgcccaacagctttttcatttagtgataagagtgaaaacacactcaattttttaaaaggttatttaccagttacgctgacagttgctcaacaaacttatcacctgacttcaaacacctaaaatgtgatttctaaagtgattggaactctttttttgaatgagtctgtggttaacaaattaggacagatgtgtattaacagaaatctctgacatgccagtgcttttgaaagtgaagaaagaattagaatcaaccattgcttacagtttgatgagctttttccaagttaattattccatgagttaatagttggaacttaacttcttgatcagattaggaaatgcatgaatgtggtagaccataaattttcattgcaaaaataaaatgtcaaattaaaataatttaacatgtgtagatactatagtatattgataaagttccaaataatttcaagtgttaggttttactaaaagtcatttcagcataaaagtcttttatattcttgagatatctttatcccatactccaaattaaattacgtatttagtgttgaggtggttaaaaatccctatcagccccacaaaattagaaaagttttctcacatttaccggtcgtcataatagcgatgaatctgatggcagtgagcaacaatagcctgaagaagtctggtacttgattaaaacttactcgccaacactctaatttcttgtagatttaacctaatttcttccaagttctggttatgggtctttgctaatttgcatggctggcttaattaataaattagatactggtttaggctgtgtttacacaaggtcaaaactaccaacagaattgacaaattcagtgggaaaaatttagccaatttgatttttaaagcatgacattacttgtttattaacatataaacaaaatgaatttgattgactgaatttttagattttcagacaatcgttttggcatttgtagagtccattgtttcccaacttttttcagtctgagacacacctctaaatttgctgggttttgtccccaaaccactctcccatatacattctaacccaatatatttatcgagtttggggttgtatatccttaactgtatatattaatcagtctccttttcctgatcatcttcatttcttaaaatccacaaaggcgattcatggaaattgaagactgttccctggtgcttattttcaaagtactgatgtgtcttgatgcattggttgggaaacagtggtatagacacagccttattccaagactgagttatcagcccttgcataatgataagtacccaagaaaataaaaatatatctttctcatagtactctgagatggaaaaataaatatataagtaatgctctgaatcacgctttgaagaaatgtaaattatgttttaaaagctggcttataaagaaaaaaaaaagctgactataacatttggcaaatagtagtatactctttctgcctttaagaataaacagattcttaaagacagcaattttaatacataattcagagtaagtctccaaaatttgtaccaaaattgtttggaaacattgaggaatcaaaatcactacatttgggtccaaactcttgaagttaactaggatttaatttgcacagtttcatttgccaaatgtctgtagattggtccaactcttgttattattttgccaagtttccttctgctgaaaatgtctgctctgttaggcttctaagtcaatgtccgtggccaagtctgaatcctgagcagtccttggaaacatgtgagcaggtcaagacaggtgctctcattcatttgatccctccccaagtgtattctctcttctacccagtatctctctaggacagttatgcatctgtctgaagcctgcacacatgataatatttaatcattttctaactgtattttccctgggatttaggaatggcagtctccaggaaagatgacagtgcatgaattttttccccctaatcctgtaaaatgttgttagttttgaatagtcgcttaaaataggttctcacttcagtctctttttttttctttctaaataaagcctgagaatttgcttttagctagcaaatccaagggagcagctgtgaaattggcagactttggcttagccatagaagttcaaggggaccagcaggcgtggtttggtgagtagggccccctccttcatgctacctatagtcttctggcttctgaattctggctcctaatcccacttcctagtgaaaataaaatggaaaacttcatcctaataacaatttgactaatttttagatattgtgcctttataagcatttaattttgttgacataaaaggttatataatctagaaataattcaagggaaaatattaatgggagaacaagaagacatacacttttttcttcaaaggatgattgagaaagtacattatttagtaagcattaattagaggattacaacattcaaagagtactttttttatttgaaagaaagttgattgtttgcatacaacctcatatgatgccaaaaactgctgtgtaaatagtagatgctcaagaaacacaggatatttcacatataatactttatgatttatgatttaaagattgtttaaaaattatgaagcatctatttatgtgtatatttcaccttagttattttgtatgtcttcaacatgccagtttcctctcaaaaattctgataatttagaaatttttatatgatgaaatttctgcttctttacaattaaggaagaaattaactctaaataaatttaaattatagtatttctaaccagacttatgttttgtttcaatattcagtctgaataaattatttactcattaattttcatatgcctctctctgccattttccaatatccaacccacttcccatgtatagttccaaaaatataacctctccccaagcctgtcttgtcttctgactttcggtgtgttgaggttagataattgttttaatgcccttcatttctgatttattttcctctgagcaacaacaacaaatagaggactaaaaacatgctatttctttgttttatatgcaaatacttttctgagtccctaatgtacacatctcccaagatgtacatatggctcccaggattcaccacatctcccttttctgccccagctgttactgggagtggagggtgtgccaagcctccctggcagcctaatgcaggacctcagttcctgctgcctgtcctttttcagtagtacctgacagttattcttggttgaagtctctctcatgtttaatattatcttttacattatctttttaccctccaatcctagatgaatttaatacctccaaacttgtcattctgtttataatattttaactttttaataagcttgtacccattaactgcaaactgaacgaaggtagggcctagattaggtctgtaaattagagattcagatgatctctgtatcctggaaaagagtacaattaacacagaaagaatatattgtaacaggagttaagggttgaacaggaagtagtggggctatcacagagatgggcaaagcaaatactagagatacataaattaagtaggaagtcctgaccctggaggagctaaggcttttgtatctataactatttaccattcagggtggaagtatcttaacataggaatgtatgaggtgctgtgggaacacaagacaggaagtacaaaaacctgcctctggagagaggttcaataattgccttaacacttatggttgcctaaaggatgaatgggactttgctcactgtcatgcaagaagattaaggcattccagacagagggatctgcacatggaaaggctcagaggcatgaaactattttttctattacagtaaaacaagaagtttgataaagctaaagtatactcgagtgagtagtagttaatgaggcaggaaatgattttatgtttttttgaaggatttggatttcaccttagagattttgggatctggtgaaacatttttagaagagagggacataactgggtgtatgttgtttaataatgattccagtagaagtatagaagatgatttaagcatagttaatctgcaagcaaggacccagttagactaaaacaatcgttcaaattatgcatgatgatagcgttgactagggagggtgtaggagcaagcaagttccaaataacatacagatcagacaggaaatatgaactctaagggaatctgtttaggaaacatgaaagtcccagacattgggttcaaagacaggactcgagtcctgtgtagagcaaagcaggaccccacttcatgagagacttggggtatgaggcaggatacaaaaatgggaacttaggcccagggatataattgccagaaattggtaaagatgatgataggatatcaggaataagacaagcctttgttatcaggtctgaggctcaaattagcatcagcagctatgtttgatgattacaagaatgttggaatcaagctccttaaatctcgtctgtttttgagcttaatgttttatctcctctgctatgacacatatagtttgagagcagggctatgtgtagtggaaaaaattttactttatgaatcagaatatatgaatttatatcttggctctgattcttaacagctgtatgatattgagcaagtcactttaaatctgtgaggtcactatcctctttgtaaatgggataataaacacttcttcacaggactgttataagattgagtgaaatagtccatagaaacttgattgagctataaaggatgttcaataagttttcaaaattgtcttggtgtgaaacaatgacataattctttgcatattcagtgagagttgtttagtgaatcagtgagtagaggactgaatatcaggtcagtaaaagcaatagcatccaaataaaagtacatagattttcaaattgttactgatttctaaaaacaagctggtcccaaagaagcagtgacagctcagcaataaaatttccacttcatcagcatggtgctatcagcaattaagttattgttaaggtacctgttagagtaataacttttaaaagaagcaacatcttaagttctaaggcaattcagtatttcagaagtacagaaaaacagagtgtctaaacttgggagaatatacttcttttttctctttctttttcttttctcaagttcaagcgaatcttcatggtaatctgagaaaaaaggagatgtggtgttctacgtttctttcagatgagctgccagatatattttaagtattaggagtaaaggcatgttttaataatgaatgacctgttttgatgtttattcattatgatctgccattatagtcccatatatttttactgattaattttatctttcaaaatgtaatatcagtgtttatggaggaaaagctttgttattttaattttgataaagagcaggactctttcttcattatgtggaataccagagcttcaggcttttacataattttattttaataaatatacgaggtccattacaaataagaaaaaacatagtatgtatacgaaacaacataatagataatacaaagcattatggaagctgtttattgttttttttttaattatcatttttcaagtcccaacttgtttgttttttcccatatttacttttcattttctagtctggtctgttggaatactagccaaaactggtagaagtaaacaccctgtcactatacttgataagatggctagaaaatttaccaaaaagaaatattcaaatatattctgtttctcttatggaactggacatgttatttgcaatacatttctagcattttgttgctgctagaaaaaaaaaagataactaccaagatcttggttcatggaagaattattttgctttgttgctgttatgtctcttttttatgatattaaggttctttttatgccaatgtgttacaatggatacatttccaacagtcagtaattctcttttctctttgtgttatctattttgattttcttattggtttttcaaagtaagaaacatatgctatccctaaaaaaggcaagctctcattactttttctattgatggcatgtagtatgataatcctagattcttgcaagtttaatttcccacagagaaggtcttctctattttaccccccatatgtctgtatttatgaggtcacattgtaccgtacattctttcctaacgtccatgcatttagatatatgcttcaatattcttggggtaaggaccccattgactgctcaaatgatggttgtaactaaataagaatgagcatgctggtattctcttagaattttagtctccagaagaggtttgtaataatttatattttaaatgatcttttcatttcttcctcacatagtaacttacttccctatcttagggaagcttaggagaggtattgttaacatttcgtacttctggccatgtattctaagttattgaaatcatacattattaaagtttactgatttagacagaagagtacagattgtatataaaagagtcattgaaattcagggtgagaagggaccaccgagaactgtaggtaactaaggagagctctaagatggaaataacttagagccactctctgttagaaaagaggtagagaaaaaatattgaggattcaaggaacagaaaaagtagtatcaagggtgacactgagaaggccatttttaaaagaccttaaagagattagtcaggtcaagggctcagaaggagaatgaaatcatgttgaatgaatgaagtgtagccggatgataaaggatctgaaagtgcacactaagaacattggatgtaatctggacattagcatcgatttctcactggagtctcattgcctgtcaactctagagaagttggagaaggatggtgagagtggaggggacagaagtgctggcaaactctttaaaacaattgtgtccatctctaccttggaattcacagagtgcatatcactccttgaggaaatcttcaagctttaggcagtggaaccaccattattgctcagtaattctctgtacctcacaactaccaaccaaatatttatttcaagtcgagtttgaggtacagatggattacccagggtccatttgaagcttaaattgcaacatacaggtcttttcttggaatcccttctcattgtctatccaatcttcccccaaaacaaacagaaaaagaagaatggtaatagaaaagaaaaaagattaagtgcaaagtttttttcctcattttcttttttgttcagagaagtaactgtgttgtatatattgtcttttaatacctctttgcatgttgtttgtacttaataagtataaatttgtcacagaaatggggaaaaagtttctttcttggacactttgcatttcaataagtatacagtgtgtttcatcagtgatctgtggttggagaaattccattatatatacttttaaaaagttttttttagtttatttgtgcttttaaagaaaacttccaaatgaggatagttatttttagtatgtttcaagtaaacatttttatttaaaaaactgttattttcagaaataaatattttactctagattctagctataaattgtttctaagtgtaacttattgaattctataccaatatgtataatatgaagttttctttccccatctagtttttcttaccacatcccttcttaagtcgaatgtctagttgatacttgttcagtagtgattcatctgaatattcctgcatcttctctttagttgccagttacaagtacatactgattatttaacagtacacagtgagctctgtgatatattttcgacttatatcttctcctggtgagttcttctccatatttcttttcaggtgtagttttaactcccatatacataaaggacaataagaattgctaaccaaaagtggccttaagtatacacagtgactttgcagcatagtagattggccttcatatctggaaaaaaagatgtattttttttcaaatgagttacagggcagggcatactagtgttgatatttctataaagagaaagtctacactatttattgctctgagaaccttgttgtgttttgaaaaacatataatcagataaagaagcccccgatatttttctttcttagtttcccatttcatattgttttgtcaaatcaactgtgactcattaacatctcttttccctaggttttgctggcacacctggatatctttctccagaagttttacgtaaagatccttatggaaagccagtggatatgtgggcatgtggtaagcaattatattttgaagcaaattttgtgataagctagtgtcttagtccatttggtctgctataacaatctgtcatagaccaagtgggttaaataacaaaaatgtatttcttatttatttatttattttgatacagtgtcttgctctgtcgcccaggctggagtgcagtggtacaatcccggctcactgcaacctctgcctcccaggtttaagcaattctcctgcctcagcctcctgagttgctgggattacaggcacgtgcaaccatgcatggctaatttctgtatttttagtagagacagggtttcaccatgatggccaggctggtcttgaactcctgcctcaggtgatccacctgcctcagcctctcaaagtgctgggattacaggtgtgagccagcatgcctggccacaaaaatttatttctcacagttgtgaaggctgggaaattcaaaatcaaggtgccaggagattcggtgtctggtgagggcctgcttttagttttatagagagttatcctctctttgtgtcttcacatggcagaaacagagagggggctcccagggtctcttttataagagcattaatcccattcatgaggcctccatcctaccaaagacctcactttccttccttccatcatattaggagttaggattttaacacatgcattttatgagggacacaaatattgtctataacaaccacaatttttataatttaaaatacaagttgaacatccctaatcaaaaaatctgaaatttaaaatgcttccaaaatccaaaacgttttgagtgccaacgttgattgccacatgtggaaaattctgcacctgacctcatgtgatgggttgcagtcagacacagtccaaactttatcttatgctaaaaaatatttaaaatatttcataaaattaccttcaggctatgtgtttagatgtgtataaaacataaatgaatttcatgtttagacatgggtctcatccccaagatatcttattatgtatgtataaatactacaaaatctgaaaaaatccaaaatctgaaacatttctggtccttagcattttggataagggatactcaccctgtaatatcttttaaatttgaagttgatattctctagtgatcgacttacagtagaagttctcaaacctcagtctacagcaagattacatggacagctgtttaaatgacagattgctgtgtttctgattcagtatatccaggatagaaacttttacctttttaacaaactctcaggtgatgctaatgctgccattttctggaacactttgataacagggatgtggagcattgctcctagtggttatgtatttatgctgctatcttctcaatggatccagccagtccttccaataagtattatgtttgcccatgatacttggcagagtttaagagtgaactagtaaatattggaaaataatgaaattgaccatcccgaggggacagaagtctgatttaggcctctatcagccaactcaaatcaaaaacagtatcctatgcaggcccaaagacatataatggggaggattttcacccacagtttttataatggaatttttatgtttcaacatatattttgaatacaggaaagactgaaagaatgctgcaacattaccctactaagattatcaacataatcacctaaattcctgatactatgtcattgctaccagcctacaagtagatacctaactatcatagtttggctttagtgtgctgcagacagatttcagtgcctttggtgtttgtcagcaagcttggaaaagttgatttaaaaaactttacttgattctgaaaataattttttagacttgttttagtttaaaaagttaataaattcatcatcactactttatagtgataggctgttcctcactatatttcttgtcagctttacctctttggtaacaacttgatgtttgatcttaaactgattgaatcttgggctttcagagttacctccatgcctgggaaggcagtggtaaaatagggcactatatttatagtttcaacccctggggttcagtctttacgttttacctactaacccagtctctttaatatatctgagttggtttctttacctgtaaaataggaatatgttaccctcattgaattgtaggagggtcaaatgcagtgcactttaaaggaagacaattgacaattgctacttaattaatgggtaaggtcttaggaatgccccaagctctgtcttcctgctacctacctgagagtatcttctaagcatgaactctaaggcatgaactctaaaatgccttgaattagagcattgtcacaaaatatctttgttcaaatctaaatgttaatggaagatatctcagatattttccttgcaataaatcagctcccagcatacatagatctgtttctgctgatgaatttaaaaagcaacagagtggcctgagactcaggcagacacagacaggttttgtgaaggatacaatcatattttttaaagtatttttaaaacatgataaagctatatttttgtaaagatagggggttgtagctaaaacgctgcatttggaccttgaacactagagggatagtgtggcatacaatagtcagtaaccaagggaagcaggactcagcataagggacatttcatactctttctttgcctgcttcatcaaaggccttttccagcctcttctgcctttgtgtttatctctccttgttttcctagtttccttcctattttctactttttttcttcatccctcctgtctacttcataggtaagaggcagtatgtatagtggttaagagaacacacttagcttctcagttcacttgctgtatgacatggcacaaattctttagtccctgtgtctcagttccctcttagaaatggagatcatcaaagttcttgcctcatgggactgcagagaggattttttaaatacagtaagtgatagttatcattgctattattatacaaagtctttatttataaatgaagtttctagataactgatatatgcattatagtaggcttaaaaaacaaagtgtattatataactcagcattattggcgtgattatcagtagaatgccctcatctgatgacctgaataccaaattctctctctccctctctctgctttctttctttacttttaaattattttcccttgttttattttgtaaaaggtgttattatggacagatttcacagcttctgaatcatattttactctgccaaagaatttaaataaattattcatttgttcttatatcgaaaacattttttcatgtttcaaatgtgtcaccataaaaaatgatagacaagtgaggtgatagataggtgagttagctctatttaattatgccacattgtatatctgtaaatatcaaaacatcatattataccccataaatgtattcaatcataatttgtcaatccaaaaaaattaagaattttttgaaaatttaaaacctttttttataatgtataagttttattggtgttgaagaatatcagatccactaaaaagaaacccaaaaagctaatagtttatgctagggattcttctctggctgtgcagaaaaatcaatgatgaagcatatacaggcaaacctcagagatattatgggtttaatttctggtctcacaatagaacaaatatcaaaataaagtgagtcacacaaattgtttggtttcccagtacatatagaagttatgtttacagtgtactatagtctattaagtatacgatagcattatgtctaaatgcacataccttacctaaaaaatactttaaaatagccaggcccagtgactcatgcctgtaatctttgcattatgggaggccaacccaggaggatcttgagtccaagagtttgagaccagcctgggcaacataggatgacccatctctacaaaaagaaaaaagaaaaaaaaaaactgtattgctaaaatatcatcatcatcatctgagtcttcagcaagttgcaatatttttgctgaagagtcttgcctcagtgttgatggctgttgacttatcaggatagttgttgctaaaggttggggaagctgtgataatttctgaaaataagacaacaatgaagtttgccacatcagttaactcttcctttcatgaaatattgcagtactcaccaaaatgtgacacagagacacaaagtgaacccaagttgttaggaaaatggcaccacagactttctcaatgcagggttatcataaaccttcagtgtgtaaaaaatgcaatatctgcaaagtacagtaaaaaaaaaaaaaaaaaagcacagtaaaaccacatatgcctttctatcaaaatgcccagatcctgcatgggcctctgctttagtggatctgtggtaaacacaggcaactgcatttttaataacctatgatgtattatcagagtttggattcactgtcttagactcacaaaacacactatgttcaattttaatattactttggaatatttgattttatgtggattgtctgagtacatttctgtaatacagttcatatatctaaccttttaaaataatggaatatcttataatagtgagatttcatatctgtgaaatgtgagagaacttataagttagaagctctaactttcttgtctggaagagggaaaaaggataggtagagagtagtttccatctttgttttctaaactatataacattttgttaggtgttaagcaaatattagatagatactacgtacacatgtgcatacatgcatgcacacacacacacacacacacacacacacatcaagaatgactccttagaaacttatagccatagggcatctcatagatttttaaccccaattttgccacctttcaccttgctatattgtatcctttcttcacataatattatgcaaacagccaaattcctttgtgatgagccttgccccagttggagcatgtatgtgccaccaatttccatttctttagagactgtgtggacgctttgtctagaaatgcacttgagatcacacagctatgaaaatgtcttaagtgttctaatatcacatgttgaggggaaatgactcccactagaacattataatgtattcttttgttacatatcttggtcattgttgtgggatttggaattgttttaccattttattatatatcacctcactcgtgtgacatgaaagtgacattaattcactttatttgtaaggtgatgtacccttaaactcatcatcattgtaatcaccaccacagtaatggacacactatttggttgcttttaggttgtggcttatcctgagggaaactcttttttagccattcattagcactgtctcttgccaattaagtagtgacttattttcaagagtagacactgggttgagtggtaaaaaattacactactcagaaaacaaaagaaatgcaaaacaagccatttagcagaaaggcagctagccttctatatgaattaagctctgaaccctcattacagcagagcagagtgaagcagggcattggtataatgactaaaacaagcctgtacattatttttattagaatcatgcaattatctgcacacaggaaatctcgaattccaacattaccttgcttttgtgatcgcacacagagtatggtctgacctgtactctctctttggaagcaactattccattactggaaagcaaataataaacattaatgaagcaagaacatagccttgtgttctgccattaacagcagtaaattgatttttatgacttaattgtatgtataactgcttccataatttcctaatgggatgaggaaatgtttgtggatgtcactggatcacaaatttctaacagagcttcttctacaatttggcctaaaaataaataaataaatgcaagcctataacataggtctctcccgcaccctatgtacatatgtgttgtcttgctacttttctgccttacttaggtatcactctcaacagttatgagtgataataaattagtggctgtcacaaatgtaccttgacttcggacaaaccttgggaattttatggaatatgtttcttcttttcttgtgtggtgaatttaggttcagcaatgatgtgttttctggggtttaaccttttcatatttcagctggtgtaagtcattatcagttactttagtcattttgaaatcccaagcctactggatattctgttgctattaccagttctgaggttaccttacacttggccaatcacagataggcctccagattagaagccttctgccttcatccattcttacccacatctccaacagtcttcagttcatggagccttactcccaatcatagtctttaccaatattctcttactctgaacttacacactgtcttaaatttctctacatttactatgtctggtttccctaacttggtgtttttcaaactctgaaacacaaaccacatggttcattcagagtgacctaaagtgcaccctcctgagatctacctcaggaccattgaatcagattctctggggccacaggatgcagcaatcccacttctggttatatatccaaaagaattgaaagaagcaccttgaagaaatatgtgtacacctatgatcatagtaacactattcacaacaaccaggaggtggaagtaacccaaatgtccattgacagataaatagcttaaacaaaatgtggtttatacgtataattgtatattatacaaccttaaaaaagaaggaaattctgtcccgtgctacaacatggatgaaccccaaggacattatgctaagcaaaataagccagttacaaaagcacaaatattattatgattctactcacatgaagtattaaaacagtcactttcatagaaacagaaaatagaaaggtgattaccaagaactagagagaaaggggaaattagtgtttcatgtatatagagtttcagtgttgaaaaatgaaaacaaactggagatctgtttcatgacagtgtaaatgtacttagtactacaaaactgttcacttaaaaattgtgcatctggctggacatggtggctgatgcctgtaatcccagcactgtgggaggccaaggtgggagaatcacttgagcccagaagtttgagaccagcttaggtaacatatagtgtgaccctacctctacaaaaacagaaaaaattagccgggcatggtagcacacacccgtagtcctagctactctgctcgagaggctgagcccgggaagatcatttgagtcagggaagttgaggctgcagtgagccatgttcatgccactgcacttcagcctgggtgaaaaagagtgagaccctgtctttaaaaaacaaaacaaaacaaaaaaacaacaaaaaaaaagatctgttttatgtactaattatttatttatttgtttgtttgtttatttatttatttatttatttatttcgagacagggtctggctctgttgcccaagctggggtgcagtggcaccatcttagctcactgcaacctccacctcccaggcagaagttatccttctgccttagcctcccctgtagtggggactacaggtgcacaccaccacaccctgctaattttttactttttgtagagacagggttttgccatgttgcccaggctggtctcaaactcctgagctcaagcagtctgcccacttcggcctcccaaagtgctgggattgaaagtgtgtgggacctttttttatgtacaatttaaagtcactgtgcgggaccttttttatgtacaatttaatgtcatgtgtttaaatttaatgttaggtatttttagcataatttaaaaaaaaaaagattcactgaggtgaggctcaggaatttgcactttaacaagcgcaccaggtgatgttgatgcaacaccaaagctaagcaatactaccacagctaatttcagattcctttaggagagcagtttttaggattattacaggatatgtcagaggttgcaaacaggtgaagtcttagttcaggctgctataacaaagtcacatagactgcgtggcttataaacaacgaaatttctttctcatagttctggaagctggaagtctgtgatcagggtgccaccatagtcaggtcaggttttggtgagggccctcttcagggttacagactgccaactttttgttgtatcctcacatggtagttaagagagctagctagctagctgccgtcttcttaaaagggtgctgttcctgttcatgagggacccatcctcatggactaaatatctcccaaaggccccaccacaccaaataccatcacattgggatttggatgtcaacatatgaattttgagagccgtacaaacattctctccattgcaggcagtctgctgtcttagtcagacatgcggacattttattcttatgagtgttgatgttaattatttatctttataatttattagcaagtaatttctataaaaactatcagtttcttgcttctctaaaataatcaaaagaacaggtgatgcaatgcttttgctcttttatagtaattgtacctgtcagacacatgaacacagctgccgccctggtgaccaccccaccccatacacagtacaggtgcaggccttcatccctgcctgctgccaaaaggcctgtcagtttgccactcctactacatggcatagatagtttccatcctctgaaacatgccttcctatcttgctggcattgatcttctagctctttgttctgcccttcattggccatttaggtcagagtgttagttgagcactttctctacttgaaatgtatgatgattttccattaatcatactacaacaaggtaagagagagccatacttatcactcatgtaattaattgtgtacttccaagttccacatgcattttgcttataagtttataatgtacccctttatttacttagaatattcagtaactgtcttagattcttccattaacttcctactatcttctcagagttctccaacattccttcttcatctctccttttgtaagaacagcatttagaatgtttaattattaacaagattataggtttaacaacttttttaacattaacttttattaaaatcaattttgaatgttctcgatgatatagtctttctacctaattgtaatcagtgcttctcaaaagtcttattaaccggacatctctagcatctcccaagcacaaatatatacataagataaggaaaactagttttaatatctacctgtatatggaaccaactctatcaaaaatagttttaactgtttgtcatggaacatgtgaaacataaaatggagagaatactataataaactgatggctaatcttatttcatctatttcctccctttcatttcccactccaatattatcttaaccaaattgaaacattgtatcaatacatctataaatattttaaagtatatctctaaaagaaaaggactctaaatatgacagtaatattagttttaaaattttaataattattgcttagtaacatcaaaatatctagtcattttcctatttatcctctcctgtcataatcttgtttggtctcttaggtctcttagtcattcttaatttgtaatttttgctccattctctcttctgtctccttatttcttgatttatttttcaaagaaaactgtagctccaagacagcacatgtaagtgctcaatcttggtctctagatactatttaccattaaaaggaaccagaactttctgtaatagcagctgatttcaagtttagaacaggaaaaaagcaagatgatccaggagcatcttgtcataccacaaagaaaaactattaaggaccacagagtttatattaacagatgcaggaaccactttgaggaggctggcactagccaaagatggggcaattgagaatcaataagaaaaataacataatagattgaaatacatcaagtaagtttaaatccaggaattgataatgataatcaaaattcaacagaagtcctaacctttgggggatgttggggagccaatgcgttattttaaaaactggctagtaaagaggaaaataaataaataatagcctatctttcctatatgaactgtatcttaggccaaccaagtggataaggagcaagattttcttagtctaaagaaagcatgatataattagagtatcatcattttgtttgtttgtttgtgagtctcactctgttgcccaggctggaatgcagtgatgtgatcatggttcactgtggcctcgaactcctgggctcaagtgatcttcccacctcagcctcccaagtggctgggactagctgtgcattccaccacacctggctaaatttttctatttttggaagagacagggtcttgctatgttggctaggctaatcttgaactcctgggctcaagtgatcctcctacatcagcctcccaaagtgctgggattataggtgtgagccaccatgcccagccatcattattttgcaaccccagtaaaattatgtaggcagtaatcataaaaggctgctagtgtcatgagagatacccaacatttggaggtcacatcatcacccctcaagtggtctcgcaaaaaaaagacttcttcattgacttttaatgattttagtactttaggtatatgggcaaagaaaaagagctagtgattttttcctttcttttttctctgacatagaaaaaaggtaaaatttaggtttattaaaaagataaattgggcttactcatgaggcaagaactcaattagaacaacaaacacttttattttattttattttatttttatttttgaggcagagtcacaagactctgtcacctaggctggtagaattcagtggcacgaccttggctcactgcaacctccacctcctgagttgaagcgattctcctgcctcagcctcccgagtagctgagactaaaggcatgtgccaccatgcccggttaatttttttgtatttttagtagagacagggtttcaccatgttggccaggctggtcgtgatcacctgacctcaggtgatttgcccgttttggcctcccaaagtgcttggattacaggtgtgagccaccacgcccggcctagaacaacaaacacttttaaaataagcatttgtttagaggacctagctaaaggaaaaagtagctgcaaggaacatttaagataggaccaaatggacatctttgctagtatgtcaaggtctctcagttagacaacacaaagttttaaattttatattatcattcctactaaagttcatagataaagaaaaagtggctgcagggaatgtttagagcatcattatgtctgtcctgcttgtggttgaaacagttacttaatctctcagcctgtttcttcatctataatataatgcagataataacaatatctacctcatagcattatacaaggattaaatgagataatgcattaaagcacacataactctgaataaatgttatctacaataaaatttattagtattacattatccttatgccatgagtctcatacttgttctatacattcagaaaatagaactacaaaatagcataactcagaaaggttttagatgcttgtttaataatcaagttgaagtaaacttacaaaacggtgtttatttaaataggcactgacaatttcacatcaggctagtcaatagcacctataatatgttttttttttaagtctttgggcctaaaagtgttttttttaatcttcacatttatgctattattttatttaaagtacatgtttttgtaaacactcctccatcaaacagctaaattgtgggcatctattacatattgcctgcttttctcatggaatgagccctctgtgagcttcctcttcccagagaagcaccacatcaactgtcaactgcagacataattcataaggacaaacagcctatgttgagaatgctaaatgtctcagttgagccactatttcataattctataacagcctaattccagatgtgtattaggaaaatgttcatattcaatggaaactatcactattacaaagcaaattttcttcttaacctcctggaaccttatatagctgagggctaaaactactcaggtacagctttttttctacttgcctcctgagaacacaaagagaaacactcatcatcatcattactatcatcattttcattagatgtatggaaaaattatttttatgtcatgaaggtgaggtaccaatatactgtggttttcttcatggtcttttttttttccttaagaatgttgtttaaaattttttatccttgtattgattcacatgacttaaaaaatctgcttatgaactgtatcttcctgaagcaggctataaaattctaagatgattaaaccattgcttaaaaaccatttcagctgctacagtgtctattgtataaagatgtccagactgctggacaggagcagggatagatctcctaggtacagagaccaagagaccaccttggataagggaaaaaataagtctcagggtacacctggcaaagtgtcacctgtcttactcttcttctcaggtttcctaggcttaaggaaacatagcaagaaaaaagcaaacaggagaggtcagaggaatgactgccttcctccaggataatgagctaggaaagaaaccaaaggccttaagcaaggcaataaaatacgtgaaaagtggcaggagagatatttgatgacagagaagaccactgtatcaaaacaatctcagacatttagactgcagatatgatttcagggaaatttacaaactgtgaatacagaatttttttaattttaaaagtgaaattagattttggttaatttataaataattatgtttgtgaaaaattttagcaaattttattacagccatgtgtttattgttattattactttgaattttctgtggaatttctcccttctctccctttttcctctcccataatatatattcttctgtagtcttgttggtttagttgtttgactgagaaggcttgaagtatttgaagactaagattactgaaaagaaaagggttttgtctctatggggtacccacatttgcagggactatggttatttagaacgtggatttataaccaggacaccatcactcaacaaaatgtcccaatgaccatcaaaacaagtatgaggaaataaaaaacatgcttagtttttaaacttcaacctcacagtgactaaaatcatagtctctatatagataagaatgcagtaagaccctctatagacaagagttcaggggggccaaagaatgttgccctaaatgaatgttgccctgccatgcctctttagaattctttgatgcatgcattgactgacacattgtcagagttctggagcataggaggagaagcattcaccctccagagactgctctagactagatcataacacatctttctgaagttttcctacaatccagttttctctgttttaacaactacggcttaatatcattgtggatcagccacatttaatttactgttgtctatatgacttaaattgtgttaacattatattctcctccaggtgtcattctctatattctacttgtggggtatccacccttctgggatgaagaccaacacagactctatcagcagatcaaggctggagcttatgatgtatgtaataactatttatatcactttagatgaaggtttgtcttttgcctgttgaccaagagccagatcttttcatttttcttttaaccataatttttaccactttctcatattatttccctctctcttaaggaaagggagaaagaaatgcagcatttgtatccagtttacgtttccttttaactcactgtctcctaagattgaaagaaaagccatgtgaagtctctgaggaagaactttgtcaaaatatttggaccttagtgcattttaaaaacataaaaattaaaatatttctgctatagaaatgattattgcctgtttagttgaattatattctcaaatatctatcacataattttatattatataccaacaatattttgctgtgatcacatatcaaatagaacattatcccactataccagtttctgggttttgttttttgtttttgtactgtttgggatactatgcaagctttcatttgaagaatgagtttcacaattgaaaaatttgaaaatcataattctaataatatatttaatttataattagaatatttgaaagtagatatatatatatacattcataaattaagttcagaatctgaagaggaaggctttatctactttctctttatggcttaactttgtgtttatgatataatttgctctcctttgatacatattcttgtaaatatgatttaccactttctcaggtttcccctcatacagccctatggaaatccatgtgcagggtctgggcatgctttccatgtgttattaagtagagtaactacagagtagcaatattgggttcaccttttgtgcacaagttgaaagctcaatgtgaaagtgagaggagaagatataaaatgtctttattatattctataatgtctcgtgaactcttcaatgcatttctgataaaaattttctatttagatggatgtgtgtgtcagcaagaattaaaaatgtatattctttgaatttcaaagcattgcattattcctagactagtaattggaacaaattattatttacatggcaatagctagcacattcaccatctttacagactagaaccagcccctctctgggcagacgtagccctgaaaatgcactgcttggtatacctagaggaatgctttcatgaaaattagagaactgaggaaaatgttcacctttcttcatgctgaacctaccgctcatttgctatcagaagacctgtacaacattaagaaacagcctcgtgtgtttctttaacagctcctaatagttagcaagcttttacaactgccaaagataagcttcaggaattaaaaaatggcaattgtttagctggcaaaaattacagatattagagtcaatatcatttttctcatgctttattatgccagtgagtcacaagttccccattttaaaactactaaaaatggactaatttaattccatgacacagtggcaatggctttatttttcaagattgtccatacaaattcatgaattgggaaaataacctgatattctatcattttgcaactaatgtggtgtaaatttcccttcatcgttgaaggacagtatttctactaaatatgctaatcatataaaagtaagttaagtaattatcactacaaaaaataatgtaaagaaaggagaagtagctttcttatatagtcttaatataaaaaagtattagtaatgggaagttataagatttgattactttcatatactttggtgaaatttgtaattgggcagattaaacttcttgaagggttaaaatgaaatcttgctgaagctcctgtagtctcagattcttctcactacagcactccaagtagccctgattaataggtcagttttggcacaggaattgaagctgttttattacctctgctattactgcttatgagttgtgaaagtatataatacctcattttgaaccttggcataatatcatgatgacattggtacatgtagcaacctgtttgcttttattaagttttgcaaataattatgagaaagattgtataaaatttcattttcagatcaaagcagagatactttgagaagaatagaagattcttaagttctttttttctgaattttaaaatgtatttaccatatgtgatatgcagctcagtacatatgttggtcccttatcagatactctttaatatatatagttgtctacatagagggggagaatagatctaaatggttttatttattttagatacaacttaacttatataaaaagtaaatttatgaagaaattcactacttgagggaatgattcatgtagttgactcttccctgtttgatcgagtgtgtctattttttaaactttttataaatttatatttttgaagtttccatcaccagaatgggacacggtgactcctgaagccaaagacctcatcaataaaatgcttactatcaaccctgccaaacgcatcacagcctcagaggcactgaagcacccatggatctgtgtaagtaaaacttctccaaaacttcaagaactaaaatgaaaaataagctctcctttaatatattgtttatggatttaaaatagctttgcaaaaaaagatgaaactcagaatgaatgaatttttgactcgaggtgtttaagaaaattaattttatgatggtgaaaaaatgcaattttcagtagcaaagtctgaattgcatagattcttaaataaatattgcttgcagtaacaaaaggaatgagtattctccatatcaattattaacaatactcatgaacaaggttaagaaaataacaccaaaattaaatgtgtcccagaagaaaagatttaacaaagttcaattatttatcattaggcaactttagaaacaagtatgaagtttggcagctgacagtagagtttcagtggcgtaaaataatggtcatagtagtctgaatatattttagaaatattaagaagaatagtgtgaaatttgagggggatctggagacttcagtaaatttccaaatgtgtcaaatgctaaggtgataaatgtggcactaagtaaatgaaaggcagctcaatcaaaatgtgattgaagacattaaaataaagataatttgagaaattattaatattcatttctatactttctggtttggttttgttttgttttgagacagagtcttgctcttgtcacccaggctggagtgcaatggcacgatcttggctcactgcaacctccacctcccaggttcaagcaattctcctgtctcagcctcccgagtagctgggattacaggtgcccaccaccacgcccggctaatttttgtatttttagtagagatgcggtttcgccatgttggccaggctggtctcaaactcctgacctcgtgatccacccgccttggccttccaaagtgctggaattacaggcgtgacccaccgcgcccggcccatttctatactttctatacgtcagtgttgcatcttggtcacaagtagtcttggcaaaactaaaattttatttttaggtaactttggcaattgaatacttagaagttgatcctgcaggtgcagcaccattaataaatatttgatgaagtcagggacattattatacttagtgtgttttaaatattctcaattaagttactttttctcctcttcttctagcaacgttctactgttgcttccatgatgcacagacaggagactgtagactgcttgaagaaatttaatgctagaagaaaactaaaggtaagaaattttacatttttatggggaggtagatttgacagactaagaagtgaaatactgtgtgaggaaaataacttctagcaaaggctttcaattatgtagacctcaatactctcattattctttttggggctcttgggaaatggaatatacaccagaatcaaaactatggtgaaaagctggaatcatcctggcaacacatgctgtggatccttccttcagtggaaaacagctgtgcaatttgataatcagaatctggcccgcacactagggccgtcccagcatcatgagagacaaaggcctttgactctcaggaaaccaaaaaacaaaaacaaacaataaaaaatcccctaactgaaagtagggccaggaaaagatttgttatcaaagactctatatttgttaggtccagaatttgcataggcaacactgacttttgtgttctaatttttttcacagggtgccatcttgacaactatgctggctacaaggaatttctcaggtacatgcattgggaactctgcttcttatcccttggtcttctttttaagtagtctctgtttttttgtctctggaattttaaaaatctaataattagaaaaacttcattgttcaggggtggcaaatgtgtggcacagattccttctacacctatggctgccattagcagtctacctgggtgctgtctgctgccgagcctccgtgactgaacccctcacaagactgcttctggcagcagtggccaccagtcagtgctggtgcaggactagcctcatctgtcaagtgctggggtgcgcacgagttgtggaaataaatactccctcatttacgatctcagcgtttcaaacctagaatttattactgatatttcataaagtaataactttgaataagttatttttggtctcattttcatagggaatcctagtatgcaagatttttaaaagaagaccattattggccgggcgtggtggctcacgcctgtaatcccagcactttgggaggccgaggcaggtggatcacaaggtcaagagatcaagatcatcctggccaacatggtgaaaccccgtctctactaaaaatacaaaaattagctgagtgtggtggcgcgtgcctgttgtcccagctacttgggaggctgaggcaggagaatcacttgaaccagggaggtggaggttgtagtgagcagagatcacgccactgcactccagcctggcgacagagcgagactccgtctcaaaaaacaaaaaaaagggaagaccattattgaggaacccagttctcttagacctaagttcattcaaaagtatagtattttcttggtgtactataaaagtgattacaactgtcaaaggtatctaactcaagaatttacagagcaccttgcactcagtactatcagagcataataaatgtccctcaaaatgattccatggtaaaaataagtttgttaaataataggcttaaagaagccaagccatttctttattgtaagcgtcactctctaaaagtggagataaagtatatattactccaagaaattacttgagttttgcaacctccttctttgatagattgtctcaaaggaccaggttcccaaaagtcaaatcttgttcaatgctaagcagtcttatgtagggggaaggactggagcagcaattaagccgcacttggtaacctttggccctttagacttggaacacttgtcagccaaaaatactaccagtttagtttggatacagtttacataacagtgatctgcagcatcaaactgtccagctattttttcaattctttattttgttttctgctacatacttagcctgggtgttatagtgttatcaggtaataatccatcatatcattattaaatgctcttcaaccaatatctagttattatttacaactgcattaagtggtcacctttctccccacctttgcatttcattacaaataatgggaaaccataagaggcctttcaaaggctgttaaaaaatagcaacaacagtagtacaatgaataatgctacgaattgagggactgtgttggccagttgtatgtattttgtccaattcatttagtgtaataataccttgttgctgcctttgtcaagttacctgtttcataaaccattgattaatatagttgacatttatatgggtgagttcaatgccatatcattaaatattaattcatatatatgatattcaaataaatttcactgtggcccagtaattagtgaatcattaaaaggtagagtgatttatatagcataaattgttaatggcaaactaacccaaactttaaaaaatcttcacatttaaaactgtacattttgttaaagaagtgttaaatacactcttgggcataaattgggcctttattaatgtatgtacccatatatagaagctttttgtttacctcacagtttccttttcatcatcatgtaaactaaaaactcatgactaatatgtgaattttatattgtttctgattgtcttagcatgaaaaagcaatttttttaatccatcacttcaaaatcaactgaagaatattagacccagttacaacatcttgtacttgatactgcattttagagtattttattcatcctatttcattgccaaacatgctctttaaagtaatttatccataagtatatggttataaagttgttgtttttattttttcttttctccctttatgtggaatgtatttcttgtgaggtaaggtgaatagtaaccaaaagggacatttttgcatctcccaggccaaatccctgcttaccctgaatcatcatcttctctttgcttgctattgcaatttcaattattctgagtttgctttctaacctattaactgccacaggattgatttaatactgctttttagctccaggcaaacaatataatggctaaggcaactatttcttacaatctcaattaataataaattaatagctgtgttgctaaagattaatgaagttaacatttttgtatcttttaagtaaatttaaaaatataccaatatgatattgaaataatggcccaaatcaatgaatgtcaggaaattacatgttcatgcagttctattctagctaggtatttccactttcgaagccaaattctattctgatatacttaaataagtatatgtaattaatattaaatgaaagcataagtgtgtatcatgtcctgcatatttgtgaatgttctacacttggtgtactaattgtcattgacagttatattatctcttcactgtgtatctacacattccttagtagatttttctgaaagggtgacttcaccttttcatatactcaagaagtttagtaacagaaggaatgttaaaagctcccttccaaaaaaaatgaagtttcatataagacccatatgctttaagatttctctaatttcgttgaagattttattctggttttatgttgtctcaaattttatgatttttactttttcattgtaaaggcttttgtttatgaagcctttgtattctgattttaatgtataaaagaatacataatgccattttttagagatcatgtgctaaacattttaaaaatttgctctaagccaataatatgccattttatttaaatagtaatattttttgtaaaaccaaattgtctgacttcaagaatgtaatgaagatgttatttagccagagcaaattttacaaatgaattttcaacctctggaaagcagggcttaaatggcagaactgacatggtcaccatatgtggtgtgaatgaacatgtaatacaatctgtcagtcagctgatgtccaaagactgaattcaactttctggattacaaaaggatagtccagttaaagttccagtatccttttcacaaccaacagtgaaataaagtccaataaacacaactggcaaagtattcaattgtatgcaacgaactactctttagttctaaatttgctgtggcaaaccaagaaaagtgatactgtatttcaatgtcctgtaagctcgcgttcatcagtgtgactttgataacttgccatatgttggccagaactcagcaaaggtggtagaaggagacaataacctgactgctttgttgtctggctgtgggtttctatggataactcactaaactgattttactctcattttacagcagccaagagtttgttgaagaaaccagatggagtaaaggtaagttaaacagatgcccctaatccatttctgactttcagatgctggataatctttaaatgttatatataattcctaagtctttgcaagttctattttttattgtttctgataaaggttgcaggttgaaatatgaaatgatttaatatacaaagatgactaacatttatatcaagaaaagctgtatttctcctgttggattatatatgaaatagtcatgaaaaaataatgttgttatacaatatagagttcctatagaaataattaaatgtcttaatctctctgatttactacagttccaaactaccatggtgacctaaaagtctgtaaaaaccaaatgcttttccaaataattatgctgcatacgtgaaggccactgaaatatatagcctgaaaaatactcacatttgggtatggaaaatagaatgtcaaatgtctaaattaatctgcttgggcagtttttataaaggtcttaattattccttgtttctgtcataaggtgttgagatatattcaagatgaatgatctgaacaaatattagaaaaatcttgcaagaaaaataacagcaggatatttttactttctggctttctaaacaaaataatacagtttctttcctactgattgtattttgtttcaaggggatttactcttgttggaatgtaatcttatggtacataatgatgtttgttatcttttcagagtaccacctaaatgttttatttctttaatccttttctttctcttccaaggacagatgcatacattcttcatcaacacttcaacgttcttgggaattaattaattttctaacatttgaatttgacccaaagtcaggtggtcagttcatattgaaaacatagaaaatcatttgtcactttaaatgttcatgctcagtcatttctttaccacctgtctgtgtgcaacttggaaatttctggagcactgatgactgtgcatttgtgatttcctttaggatgccatttccatttaccaattgctttcctcagcctgcaattgtgtcttcattctgattagtttattccatttagattttaagaatgatagttgatgactgcctttttcccaatgttacaatagtagaaatgtggtatcttacattttccaaacattttcttctcctgggctttcctgtaccgttcagtgatggagagctcacagttcctattgagatatttattttcattactatccttacatagaacgcatttccagaactttttccttccattcaacttatagctcctctttaaaaacaaaattattctatactccatgctttgatactctaaattcaaccggtcatatttttttttcttttcctttctctttgactggtcaattcagaaaaggaagtccagttcgagtgttcagatgatggtgaggatctatctgccagatttctcctcctgtgaaaattcacacttaggaataaaagtcttatttacctaagatagtgtaagtaagtggagagggtgtaggaccattacaggtcagtgttagtcaactatcaaaacacggtacttctcttacatattacattgttttttctctgaaattgaatttgttatacatgtagatagtatattaagaggtttgctcttttacaaagtcaattttctctttgaaaataaaaagaccatgacagaatgaatgtctgtatagtgatcagtaaaaacaaacaaacaaaaaactatatgttttttttaatgttctttatggttgctaaaataggagtgatttataggacaccataatacattcaccatggagtttataaaggtgtgaaagtgatcttacaatgtaccaatcctagttaagtacctttaaaggaaatgtttattaaccttcaaacaataaatttaacacctgagaaataggaatatcttgcccatgcctcataagagtaattcagtgcatcatacaattatctgatttgattgattcatgattttttaaaaaagaaaaacaccttgcttctattaacataaaataattatatcacacaaaagtgccagagtttttgtatttttaaaagacatctatgggccaggagcggtgtctcacacctgtaatcccagcagtttgagaggttgagacagacggatcacctgagatcaggagttcgagaccagcctggccaacacggtaaaaccccatctctactaaaaaaaaaaacaaacaaacaaaaaacagaaattagccaagtgtggtggccgtacctgtaatcccagctactggggaggctgaggcgggagaatcacttgaacccagaaggcagaggtttcagtgagccgagatcgcgccatggcactccagcctgggcaacaagagcgaaactccatctcaaagaaaaaaaaaaaagacatttgtggttgaacctatacttatatttgactctttgaaaagaacgtcttcttgccttttgcttagaaattatcctattatttttcaataaattaatattataaataactgcaaaagattttccataggaaaaaaatcatttagttagtctttacattaacaaaaaagctttaactgcatattaaacatgaccaaaagtgtggttgaggcacatattcatttaactcatgtttcccatacctaacaataaagaatggctcacccagacagaatggccttcatctggaagagatgatggtgtgtgtatgctgtgtatctgtgtgtgaatgtgtgtaggtgtgtgtgtgtgggggggggaacatgtgcacttgtacagataagtttgtgtgcacaggtgtgcaagtgggacattttcactaaaataaagcagttcttggcaaccacatcctagaaaaaagtcaagtatcatatcccaaaatagaaataaaagtatctcagaatatttctttcatttgcattcactgataaaaactaaatatagcatattaaatacatgtggtgctttaaccataagtgcccctgttcatttgacaggaagccggctatgttttgcctagcatgtttcccgaataggaaattattcgtgtgtgcatccctccccttttctcacgtaccctgtactaacataaatactgaattttgatccctctttaatagactttttacctcttatctctttggctcttgcacaaatatcatgttaaattctgtgcactttgatttaaaggaaaaaaaaggttttaactatctgcagaatatagattgatgacaacatttatagaattttccagtaaaggaaagtttagaagttttctcatccttttctgtgggtcaagcagcacagtgtcacaacttattgtaaaaataacgataccagtaatcagacaaaagggaatgaaaagaaaggaaaaatattacatatttaaattaatttatgttactttctatcttcctctcaatactagttttgacaggatatatagttatcagatatagacttccagaaaacccgaacaattaaactggtgtcaccacttgaaatgctcatttgatactcatttattttatatagtatatgtttctctttacatcattatctatatttatattaaaatcatggaggtatattcctttagaaaataataaataaaatacctagataatatagtataagaaaatgaacgttaccttacatttttgtttgagaaccgtaatgtaagttgtcatgcatgagtttaaaagaatgttgattgattattatttttcagtccttgattcttagtgccccgactcagttgtagtttctgattgccacttgtctacaaagagtcttctctgtggaccgttagaacacttattgaccctctgagttgcttttaccacgcagcttccacagtggtaatgatatattctttaaagtcaaatccagttatgttaaagcaagggaatgatattaccaaatatattctgcagtgatagcagtagcacattgacagaaaatgtagtattttcctcttacacaactgtaaaaattaaagtccttttacattcaacataaaaagtttgatttccccactaataattgaagatgtaatttttagaggagatctacacttgtcatttttaaaagctattgtgacaccagcgttttctcagaagatctaaattttcattggataatttaattgctcctaagcaaagtaatgctggatccccagagaaagatgtatgtgtgtgtgtgacttcaggctcaagaataaaatgagggaagaaagaaatatatttataactgtgaacaattggaagcttggaaacagaatccaacttgaacagtatgagaatggttatattaatttcatactctgaaacctgattggagctccactgaagcagctctttgtttgctaaggtggcatagcaacagcagacacgtctgttttctcattgcaccatcacggacatggtccagcctgtgtgtgaccatcggagactagcgatcatcattcctgtcagtcatcaccatgtctttcacgttcatcttcagtggctctttatcttcatgtctacatctctatgtagacatgctgcatctagagacattggctaccaaggggtttaaggcatctctgtttctattttctgcatacccacagataaacaacaaagccaacgtggtaaccagccccaaagaaaatattcctaccccagcgctggtatacctggactctttgtaacccttcttaagttctttacatttttttttttttgtggtttctctcatttgctttcactatatagatacatatatataaatattttatttcgttgggtgttgggttttgtttttttttttttttgctttctatgatatgaccaagttcatttcttttggttttttttggttaagttagttgtcaagcagtgtgttctaacatgagattatctcatttcgttgttgaacattgtactgatagctgtggtctctgtagttggaattactgcatgctgcattcaaaatacagcgctttggttgctcttagctcttctgatgatgatagttctagattatgcaaacaatggtttcttcttttcatgatgcaaatgcttacatcaaggagagctaatgggattgttgctagacaacatgaaagtagaccttattcagagttctcgtttccctcttattaaaacacaacagggctttgtaagacttcactttctgagataaagaggcactggataatttagagctttctgtttattatgttttaaattaaattttcactgtttcactttaatccaaagaatgaaactgcaaagaatagaggtttgaattatcagtggaaaccagttatgtctatctcaatcaaatccacacaattaacgactaaattagtctaacactttgagatggtattatgttaaaattcagaatttgaatactgtcattcagtgctgagttccataacattttccctaaactgtttcatattttgatttatgattttcagaaatgtttttcaattatttgctcttctcatactgttattttaaataaatttaaaaatgttaaggaatcatttcacttgagttaaccatgaggctccatttaaaaacatttaaaaggaggacacatcaaaataacaggttatctactagtaaaaaacaatgttgatcacagctgtagccaagggaaagggagaatggaagcaggagatatgtctctcaatattacagcagtgtaaactgtagtggtgggggagtgtccatgattgagaactcccagtgggttgcagtacctccccattgccaagatatcacacaatgaaagtgccaagcatgtcactgatgtatgcatattgaatctttttttacatcagttatttgaatgttattctccacttgggaatatttctttgctttctgatagaaaacaatagaaaacccatactttcttcataaaaaagcatgactttatagccagatatcctgtatatatagtccataaagtagaagttttttagatatgaattaatacaggatttaatagcagtatgcctcaaattatagtgattacatgattagttctagattagtagattagttctagttcatgattagtcccttaaactttttaaatgttccttaaaatttttttatggtcttttgaaatggattctttagtatagtctttttttaagtgttgtccaatggctctagattttataagggtattcagttacgtattaattaatgacaccataatcgagtttcaaaccaatataactgaaaaaatatcttctctgagaatttgaaatcatctcagagttttagctccagtgtccttggccagttctctatgggacagacgttcacaggccactcattaaagaagaaaggaaagcataggattaagtgaaacagtgagtgcctcttcagatctctaaatatcaaagccttgtttgaatgctgatcaagaataaggtcttttgcatgctgcttctgggtagggaggttcctatctcatggcctcgccagggagatctttcatcagagatattgtcagctgcaactctgacagcagttaacatcgctttagctcttgtcactatttcattttgtcagctggctcactctgctctgtccttcacactagaaagaatgtacttaccaatgcgaactgtttctttctctattttgttctcactcaggagccccaaactactgtaatccacaaccctgatggaaacaaggtattcagaaagaatcaacatcatcttgctttaacaagactatacatctcatcaaatattcaaaaaaattaattcgttatctaaaaataggaaagaaaattctaaccattttctaccacacttccttttgggcctaatttatctagaactatggacatacttcttgcaaataaaaatgaatgacatcttgaaagagaaactaatgttaccatgagtcaataaaagtcaggctaaacatgaatgaagtctttatgtcaagatgactgtgtgtcttaagcaattccatctggtcatttttttccccatgactttgtgctttgtactgtagatatattgtgcatgatattttagaatttctggcaatattccattgtcttcaaaaatatcaacttgactttataggtttttttttttgtttagtgttacttttgagttttattctattctgttgtcagagtggtgttttttttttttttggtttttggtttcttaattccttgttggtgatgatgttgttattgttgttattgttgttgttgttgttgttgtttggcatgaatttgaggtgaatcaaggagtttcactttttgtgaaatatgtttgttgttgagtaatatatattccagtaacaggggtttaactacttaggttgaaagaagactaaatgtttcctatacattgtaaattatttgtatagcatgttaactaaataacagcactagcatacatgtctataggatgaaagaccttttctgaatgtattccatgtgtccaatttcttacttttcatatattattatatctctaagggaagaaaaaatactaaacttttctcaaatattagatatagtcatgcatcttctccatactcttatcaatgatgtttaagacttagaaagcacattttatcttaagactcagaaaacacatttcctctctggtttaacatttaattgatcaatattaaaaccattaaagtaaaaaacatgaagtgttatgttctttaatatgagatttattttatagtcatgacactgcaaatggtctaggtcccgaaaagccttgaggtagtcaggaccatcacatatgagaacaatttttttaatagcattagccaatgaaacgccaagcataacagctggaatggacacttcagtagttctagctatatcatttgtaagagttgctgcatgatatttcttgctgacatgaattagtttaattttacagtgcatgggtttaccttcattttcagcttacatttgaatactaggtcacattaagaaatgcatgaagattcctttctttggttttgtgtgtatggagactctgggtacacctttaattagtttttcccttggtttaaatattgtatatgatatttatataaattgatcacttttttgaatactgaatctctaaaatgatactggctggtgtttacattattttccagaatctgttttccattactgagctattgattggaagtttgtttccagttatttttggctctagcatttaatcattccaagtagaaaactatgtctttcttatgaatattgcaaaatttatttgctagaaaatattttactcatacattattaatgagcacatttatcacaccattttaagaaatgtatcttaattctggcagttacagtgtacttttaagtgtgcttaacaatcttccacttaatttgtagttttacaaagaaagagctttgtctttttattatggagtaggtttcttatcaataacagccagttgctatttttgaaaagaatgaaaaaagtctaattgtccttgaaagtaaattattcattataattccattgtgctgaggacaaacatgaaaattcttctcaaaagtactttcagcatatctcagcttaacccccttagcttcttcattaaatgatgcggtgaaatgctttctctccctataaaggtgtaaggcatacaggccttaacatagtgcctgacgcaaagaaggtactctttattgattaattaattgggaatagaaattttttctattttaagtatcaaattcattcggctaacatattcaattgcttgtagacacacagaaaaagcaaaccttatagggcactgtaacacaaaacacatccttacacagtttctaaaataaactgcatacttccgctgcttctacaaatcacctggatttatacagcttcggagattaggcaaccagagtactccgtttgaaatgtttgcagcatcagacattttatttctgttaaaaaccacttaatgtgtttgtccatttgcatgtcagcatatgcacatagcctgctgaagaattttgcatgatatgtatgtcactagccaatttttaaggaggaaatcaagctattcattgcgtgcaacctaaaaatgtgttttcttctcatcaggagtcaactgagagttcaaatacaacaattgaggatgaagatgtgaaaggtatgatttaaccagaaatggaaaatcctacctcagagcttcacatatatatatgaaaaaaaaagtgcttcaaataactaataagtttaggaagtaggcctatcctaaagcacaaaaatattttatttatgagtaaaaaatatttttataagtacataattatttcaacaatatgttacttttgtcatttttcctacatattcttttatatattttgaactgtagacatgtagcatattctagcacattgcagtaatgacaactaataatgagttactagttataggaacataacaaattgtaaatttgtcagtcaaaaagtaatataaaatgtatacacattgggtacattcataaaacctatctggaaaacaatttatattcaaggatacagtataaaaataactttttaacttttagtcatctcaaataatatcagtagaattttctatttggccgcctttttatcctagctttttgtgtacattccaaaggtattcttgacctccattcactttggttgccaaggttcttttagctacatgtatgagtcattggtagtgtttctacagacatcttctcagtgcccctgcacacacatactgaacacacatttgcagttaggtcacctcctttggccacatcactgttttagaagtattacttttgtatcaattgcatttgcagttttatgttgtttttgtaattcattatatataactacagtctctatagaccagttgtctagaagatattctgacaaacagcggtaacagtaggatatttgaaacagaaatattaaaggaaaagaaatataaattgggagcaatgatccataaattaattaaacctcatctgaaaagattactgacctaatagtatcaccataagctttaattctaaaggtagtgttaatacaataaagtcttgtaaagttgtattcatattttagaataaaggatttggaaattctcaggtcaaggagacgtggggtcaatttaggaaataaaaatggctgtagatcacaacttggcagtcagctctgctgactttttcctttttgtttgaatagaacagctgatgctgttaaagtgtactctctatttatataactaagcacactgacctaactctgctagaggtagtcagtcattttttacagtggaaaggtagatagctgtgtcaagaattttatttagtaggtctattcatctcactctttgcacttaagctaaaatttgaactgaagtagttttatgaatcattgataccagtcatattagataaaaatattctttttttttagccaaataaatagatatgccatttagctttcccactgattcaggaagcattatctttgtgttttggattcattagctctttaagctaagctaaatgtttcatatgaattttcacattcttcccttgagcaagactaagaaaacttgttcattgtccactggagaaactgaatctttaaataaccaaataaaattaggagaataccagcaccttactatatgcagttcatctgccaaggaacgtaatcatgagaagggttttaataagtggtctttctcacctgaatttggcactcaactgtactaagtattggttcaggatcattgctattaatctatgtaaacattaatgtataaacagagttcctgtcagtgttaccttgtagtttgtaatttatttttgataaaatgaaataataatatcagttcttagaaaacagttctccaattcaaatcataacaatgatatgggtttcatcttgcctctgggatttcataaattgagatagtatttgtatttataattacattgagtctgtatacaagtattagaggaattcagcatcatattgagatcaaaagaaatgtccagttgatcgtttaacccaaagtgcttagctttattaccttaataaatacattatttaagtttctgcttaattttgctggtgtggatctggccaaaaatgtcataaccatagcccattaggactcatttgtgttctctgtaagacccagacagccttctggagactaacccttttaatattgaatgatatcagaaacctttaagactagaagacactttgaaagattgcctaggccccatcatttttactgggacaagtggtagataaaatggtcttaagtgattttaaattatttattatgctgatgatctgtttgtgtgggaatctctccatttatcagtgcatggtcctcaagaaagaccctatatgtgaataattatgctctcttatttttactttagaattgctgtggctctcagtagcttggtagggaatgtgtttattgtccagctctgttgaaaccaaaatttacctatatctaacattctataactaacatccaagaactcacaattactatcagttaaataatctgaccaaaactgtatcccatctacaaaaccatgtcatatctacaaaactgtgtcttccacacacatacttttcaaccttctcttttctgtagacaacattgtgatcagtgagacaccacactttttgacatattcttaaaggcatacccccatacatacttctgcatgcgagcacttgctctacccattgctgctggctgtcccagctatagtgcatctaacaccagcacctagacttacattgttttatggtggtatatgattccttgaataccatgtcacatgcctcccataccaaggcagtgcacattctgccccatccccaaggactaacctggcagggacagcttctgtgtcctctccaatgtaaagaaacatggagttgctggaggaggggattaaacactgtggtaacccggtcaaaggaagaaatgaggtaaactaacaacaaagtttttctttctggcgtctttgaatgggaaaaggcagacaaggccagctgttctcaaagaaagataaaagaaagcaaaagtagtcagagattaatggttcctcagtctggagcaccttagaaagccaagatttaaaggcccattttccttcagctcttctaattagtttccattgagaaatcatgtccccagtctgtgtaatacttttgaattgtgtctaggctgtttcttcattcagcaaatatttattgaatcccttctctttacctgacttccatgtgcttctctttttgaactagccatgttcaagagatttgaatgcaccagagtcaaaatgctgtttcctaccctttatatgaatcttgttatgctataatgtaggcccatttatcttacttaatacaataactatcaagaaaaattagtgaaacccaacatatatgcatgttttacctaaaaaaaaaaaaactcagtgaaacccaggaaaaaagtgagacccaaaataaatacatttttttaaatctaaaagttcttttatttcctttttcttaaaaaccttcaacatttagctctaaccacatttttcttcccaagctcgtaatcatcccaagggactggcattgttttacaactcttctttttaaaaagcttccagagttcattgttttctttctccaaggcaatgtgttgacaccctagtgttgacctcttgagcagctttctaattttgttcagtgtttaaaaccaaatattatctctgatgatgctatgtcaggaaactcagcagcaaactcagtgtcatggagagttactaatagtttaaaagcaaatgggagtctgggagtggtggctcatacctgtaatcccagcactttcggaggctgaggcaggcagatcccttgaggtcaggagtccaagactagcctgaccgacatggtgaaaccctgtctccactaaaaatacaaaaattagctgggcactgtggtacgcgcctgtaatcccagcaactcgggaggctgaggcatgagaatcacttgaacccggtgggtggagattgcagtgagccgagattgtgcctctgcactccagcctgggtgacagagtgagactttgctttaaaaaaaaaaaaaaaaaaaagcaaatgggagtcccaataaagcataattaccatcatggaagcactgtggtaacaactgcccatcctatataagaaaaaaagttttcttcttacaactaactggtgttttcaaaatatacaattctttaggccaaaaattgttgaaatagtcatttccatttttaatcaatttccagtaaaacagctacttccattgatttaaggtgttatccaacagctgtcatcattagctcttaattagcagttaacagtacaaactgcactcctcgccaggggtgtgggtgtgcctagagtcagtgatgtgtagcagtagttctttccacactgtatacatgtgaagaccgtcctttggtttgtggctgtagccacagtttgcaggacctgtcgctgtatgccgcaatgcctctccgcctcataacccatccagcaccattgttcagagtcacccacttcctcctgatgggtacatgtccatatggtccatctgcttatgtttcccagcattcttgtgcagcacctgttgaagttgggctcctgtatgcccttgtgtcatttctgtcaccatcctgtttccagtatctcacttcagctcaccattcaccacgagcttggatctcttgctgcatttcatccttcttacacatctaggaaagtggagccctttacaacaagcagattctatggctatgagactgtgtgtggagacttcatccttcttgaattcctttttacttttcctgattactaggtagtagtaatgaggatgtttgcaaaagtctcaattaaggacaaagttgttggcacccttattacttgaatggtgattcatgtttgatgacctggatatcgtggtctcagctaatttatagaatcacttgattaatgagctctctgtgtgggtcttctataaatatgtacattagtgaatagtatgatgactgattacccagattcaactattcttaagttctgtttgatcactgaaaaccttcttttctgtgtgggatttcctaaggcagatgatctcatggtactgatcttcttggtatctacatgtaatttatatttcaggacttgtcttgcatacatttctcacttccagaaaaatctgcaaattaagaaactcttgggtattttattgagggacttttgataattatgtcattccattaggttaaaaatgtcttagaggaaactgtagtgtagtgtataataacttctttcaggtttctaatccaaaatttgattttacaacaagtttacttagaaaaattactggggggaggagccaagatggccaaataggaacaactctggtctacagctcccagcttgagcgacgcagaagacgggtgatttctgcatttccatctgaggtaccgggttcatctcactagggagtgccacacagtgggcgcaggtcagtgggtgcgcgcaccgtgcgtgagccgaagcagggcaaggcattgcctcacttgggaagcgcaaggggtcagggagttccctttctgagtcaaagaaaggggttacagacgggacctggaaaatcgggtcactcctaccggaatactgcgcttttccgacgggcttaaaaaacggcgcaccaggagattatatcccgcacctggctcggagggtcctacgcccacggagtctccctgattgctagcacagcagtctgagatcaaactgcaaggcggcagcgaggctgggggaggggcgcccgccattgcccaggcttccttaggtaaacaaagcagccgggaagctcgaactgggtggagcccaccacagctcaaggaggcctgcctgcctctgtaggctccacctctgggggcaggacacagacaaacaaaaagacagcagtaatctctgcagacttaaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcacactgacacctcacacggcagggtactccaacagacctgcagctgagggtcctctctgttagaaggaaaactaacaaacagaaaggacttccacaccagaagtccatctgtatatcaccatcatcaaagaccaaaagtagataaaaccacaaagttggggaaaaaacagaaaagaaaaactggaaactctaaaaagcagagtgcctctcctcctccaaaggaacgcagttcctcaccagcaacggaacaaagctggatggagaatgactttgacgagctgagagaaggcttcagatgatcaaattactctgagctacgggaggacattcaaaccaaaggcaaagaagttgaaaactttgaaaaaaatttagaagaaggtataactagaataaccaatacagagaagtgcttaaaggagctgatggagctgaaaaccaaggctcaagaactacgtgaagaatgcagaagcctcaggagccgatgcgatcaactggaagaaagggtgtcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctggcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggtcaccctcaaagggaagcccatcagactaacagctgatctctcggcagaaaccctacaagccagaagagagtaggggccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagttcctgaaggaagcactaaacatggaaaggaacaaccggtaccagccactgcaaaatcatgcctaaatgtaaagaccatcgagactaggaagaaactgcatcaactaacgagcaaaataaccagctaacatcataatgacaggatcaaattcacacataacaatattcactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagaaacttagactcccacacattaataatgggagactttaacaccccactctcaacattagacagatcaacgagacagaaagtcaacaaggataaccaggaattgaactcagctctgcaccaagtggacctaatagacatctacagaactctccaccccaaatcaacagaatatacatttttttcagcaccacaccacacctattccaaaattgaccacatagttggaagtgaagctctcctcagcaaatgtaaaagaacagaaattataacaaactatctctcagaccacagtgcaatcaaactcgatctcaggattaagaatctcactcaaaaccgctcaactacatggaaactgaacaacctgctcctgaatgactactgggtacatagtgaaatgaaggcagaaataaagatgttctttgaaaccaacgagaacaaagacacaacataccagaatctctgggacacattcaaagcagtgtgtagagggaaatttatagcactaaatgccaaaaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaccctttaaaaaattaatgaatccaggagctggttttttgaaaggatcaacaaaattgatagaccgctaggaagactaataaagaaaaaaagagagaagaatcaaatagacgcaataaaaaatgataaaggggatatcaccaccgatcccacagaaatagaaactaccatcagagaatactacaaacagctctacgcaaataaactagaaaatctagaagaaatggataaattcctggacacatacaccctcccaagactaaaccaggaagaagttgaatctctgaatagaccaataacaggctctgaaattgtggcaataatcaatagtttaccaaccaaaaagagtccaggaccagatggattcacagccgaattctaccagaggtacgaggaggaactggtaccattccttctgaaactattccaatcaatagaaaaagagggaatcctccctaactcattttgaggccaacatcattctgataccaaagccaggcagagacacaacaaaaaaagagaattttagaccaatatccttgatgaacattgatgcaaaaatcctcaataaaatactggcaaaacgaatccagcagcacgtcaaaaagcttatccaccatgatcaagtgggcttcatccctgggatgcaaggctggttcaatatacgcaaatcaataaatgtaatccagcatatacacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaacctggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcctgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatgaccatactgcccaaggtaatttacagattcaatgccatcctcatgaagctaccaatgcctttcttcacagaattggaaaaaactactttaaagttcatatgaaccaaaacagagcccgcatcgccaagtcagtcctaagccaagagaacaaagctggaggcatcacactacctgacttcaaactatactacaaggctacagtaaccaaaacagcgtggtactggtaccaaaacagagatatagatcaatggaacagaacagagccctcagaaataacgccgcatatctacaactatctgatctttgacaaacctgagaaaaacaagcaatggggaaaggattccctattgaataaatggtgctgggaaaactggctagccatatgtagaaagctgaaactggatcccttccttacaccttgtacaaaaatcaattcaagatggattaaagacttaaacgttagacctaaaaccataaaacccctagaagaaaacctaggcattaccattcacgacataagcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaaccttctcatctgacaaagggctaatatccagaatctacaatgaactcaaacacatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaattctttgcagccataaaaaaatgatgagttcatgtcctttgtagggacatggatgaaattggaaatcatcattctcagtaaactatcgcaagaacaaaaaaaccaaacaccgcatattctcactcataggtgggaattgaactatgagatcacatagacacaggaaggggactatcacactctggggactgttgtggggtggggggaggggggagggatagcatcgggagatatacctaatgctagatgacgagttagtgggtgcagcgcaccagcatggcacatgtatacatatgtaactaacctgcacgatgtgcacatgtaccctaaaacttaaagtataataaaaaaaaaagaaaaattactgtccgcatatactacctgctgattttttaagtgttgtatcagaattagtaacttatatgactgatgcagaatttattctattccaccactaatgtaacacagtttcattttctctatttttatatatttcttctattttacctctatactcaatttttctctttattgcttgagtcctgccaagttatcctaagttttcagtgataacctcaagcttgtttagctctgctaacaaaatacagggtcaaactgttgccaaccccattttaaaacaaggtccaaaatcaagacaaatggaaccaacaaacaaaaacatgtaacttctcattttaacattaggaaaacatcagctcactctatagtaataaagtttttctgctcaaaatttctataaatagcttttcttgtgagtttgtgaaaccctgtaatgagttttagaactatccacagcaaaaataatgtagcattgttttataaaaaactacataaactctaaaggcatatatatgttgtaagatttcttccatcagattctaaactttgattgagctatcaatcagtttttaaactgtgaattcactttaagaattaactttaagaattcagagtttaaaaacctgacatttacccacttatacctactgttccattatcgaaacgctaagcatgtgagagttatttatatcctactgctcaaggtcatcgctaaggtctgattttccactcacgcaaaaattcaaaaaattgcaacctccagcataaatgggttaactattcatagatattactttatgtgggagttaaaaatacaagaggtaatcagactcacactttgtgtaatcaaaaatttcatagttatccaaatataatttactttataatatagttacataaatgttgattataaaactttctcatttttgttcatgtatctatttttttcccattacctaacaaaaattgtccaatttaataagctactaaatctaaggtttgtgtaaattttaaaatattattccttctatcttctttattttttcagattatggctttatcactttttttaagtgatgtaaaatataaaatgtcagcaaggatctgatttgaatctgaaatctatatttgagcaagttacataatttacctgtggctcaggtttcctcataacagcagaatgtagatattgaaatcaataatacagacttttaagctctttttctactctactgtgatgcaatactattaatagattattgtaagatctctttatataaaatgatacattctaatacatattattataaaacaattagatgttaataatataaactattcaagcagtcacagaaagacatttaactcaaagtttaaagaaacaatacactgctacagttttaggaaatcttattaaaactgggaaaaaatggtgttcaccaacctgaatatccaaaatgttatcaatagcactataggactataaagttactactttaaacacattccagtgagaattattatgaggtcaaattttatgtttctaaagtttccatacaaaatttctttaatatctaaaattaaattaatatttgagctcattcatttctatatagaagttaaatcctaattatttgctatgtttttcttaactatgaattttatgtaattctgaaattatttattagagtaaaataattgcttgagtgaaataatgtctcctttgctgagtttgtattattttataccaataaatatatctataaattatgtaaagttatatgtctatatcatgattctttttgtgagtaagtggagtggccctaattttattttctgctatggatttctgctataacccccttgatttggtcaggaggaattaggtctaaagtatttaagaaattaatctcaatcctgtgcaattttaatatcccaccaggttacaggtgattttatctcaagctaatatgatagatgataaagtaaggaaaagcaagatattagcaagtgaaagcagagaagacattattcagtgaggagcttaatgaaagagcttgtgtagaaataaagaatttttatttttcacatccgaaacagtggtattttcacttttcaatttagtgcaacaaatattttatgaacacctgtaatgtatagtcttctaactagactctagaagatttagaaaagaaagatgattctacaagataatgttgcaggcaaagacacaaatgattgagagagtttcaaacggactgggctaattctgagtggattatagggactgtattctagtataaatcaatagagagtgaatcgtgatcaatagcacttaactaaactacaatagttgtgttcagtccagggagggaaactcaacaaggcagctttcctaaacatttccaagctttgttgttatattaaaaaataatttaacagcattggctatcatgtaagtatagcatcaggaagcagagattgggtataagaaaaacataaacatgccaaggattcaggcttaatattcttgtacttggaggtatttttggccataaagtaaaaatgcaatcaatgtattggatagatgtaatggcacacattttctgtctgtgtctttgctgtgagttttcctttccaaagttctgcaatatattaaaactgaaatattgagttttcttaatagttctgaggtaagaaaagattataatcacccaagcccagtggctcatacccgtaatcccaacattttgggatgctgaggccagaggatcttttgaggccaggagtttgagaccagcctcggcaatataacaagaccccatctctacaaaaaaagaatttataaaaattaggcatggtggcacacacctgtagtcccacctactcgagaggctgaggcaagaggaggccaggagttcaataccacagcgagctatgactgcactactgcactcactccagcctggatgacagagctagactctgtctcttaaaaaaaaaaaaatcaaaggaggaactacttaatctcttttttgtgactttcttctgaaaattgagtttatagaaagctggtctaatctgagagagttcattcactcttcatatctcttcaccaatggtcattctgaaaggactcctcaaagataaaactcctgaacttagctttaaaggggaaggtactattaaccaggtgaagaaggtgcgagaggagaaacattaccaatagaaggcacagaaacaaagcatggtatgtctgaggtattgcaggcagtcaggatattactgaagaatgaaatgcaagttggagagtggtagcagatcaagcttgagaggagggaaggtgctagttatgggagcattgagccatatgaaggagcttgagctgatctaatattaagagatgagaggcatacatcatagacaaggatgattctgcaagataatgtaccaagcacctgaggaatatcagaaagttttaagcagaggaaagatgtggtaagatgtccataggtagaacactctggtgattctgtggcatatgtatttgaaggctataagaccaaagatggttagaccagttttaagactatgtctaaagggagatacatggtcaagggagggttgagttttgttttgtttatgttttaggatgaatgagtctagatcaagtttgtaggctaatgataaaggacaagtaggcatgaagaaatttgctgatcatttttacatttatttagtaagttactctttcagcaaatatttagtgagggactattgagtgccaagccctgttaaaagcgctggatattcagaggcaacaacatagataggatttcaactttcatgaaagttagattttagtgggcagaaatagctaataaacaaggctcatagtttctaccaaagacttacccttgggataaaaatgatcacagagtagctaaagactttaccttacattatcctgattaaaaactccatttgttaagtaggtcttattaacccagtctttcaaaagaacaatctgaagcttagagaggttaaatcatataaccactaagtgctttaacaggagctgggatcatgctttgaaccactgcactgaaccacgtggggatttatggaatccctcagccctcacattactccaatattatatcgtatgcatttaataatatgtaaaagtattccagaaaggttagtggcaaagacacttgccagggaggttttctatcaaacatgaagacttccaagttaggtagcacagtctaatcttacatctgcaggaatcatcttttgctcctgggatcaggtatgaggtcctaaataatgaggaaagatgaaacataattcaggataatagcttatcttttgtaaagagcccccaaagaaccttaaaaccatttctgcttataaagtttagctctaaggctataaaggaatgtgttgacttgattgataacagcatgttatttgtcagtttttgtgaagttaattctactgaatagaaccaattggtgtcttgcatctatatataaaatgctgtaccattgtatttgtaaaacattttaccactatgttttagggcttttttaaaaaatctcatttaatctgtacagcaagcttgtaaaatcaagaaatacaataaagaagggactcaggacattgcaactatgtttgcaatgtcctgagatctggaatcatataagcagagatctggaatcatactagccctaatggcctcctttcagagaagatcaagcactttgacaggaattagggatctagactcattcttagagagagatagagacattttaaagctattcctggactagtcatctataagagaagtggaaaaaggactataaattgctctttaggaattagacattgggttactaaattccatggctgggtagaagggatgaggcttgtgaatatcacaatggaaccaggacccaggatgggagtgggtaagaaagggaagtttggatagaatgggtatatagggaaaggtcttagcttgttgtgtaaaatgtgtaattttcaacaagtctgtaattaaattctttgtttcagaatgccccacagatttcatgagtctctcggtatcttccctacctaacacaaaattcagattcttagtaaaatatccataaagtgactctgtttacttgacttaaccaattattgcttatatggaaacagacattctcatagatgcacccctttttcatttaaataaaaattgggcattttctttacaccttccacattagttcccttatgtatttctgcttctgattttgaccttttactgttttctcatttttttattttttagagacagggtctctctctgtcatccaggctggagtgcagtggctaaaacaagaaataatatgtgcattaaaaaaataaatacggccaggcacggtggctcacacctataatcccagcactttgggaggctgaggcgggtggatcacctggggtccggagtttgagaccaacctggccaatgtggtgaaaacccatctctactcaaaacacgaaaattagccgggtgtggtggtgcatgcttgtaatcccagctactcaggaggctgaggcaagagaatcgcttgaacccgggaggcggaggttgaagtgagccgagattgtgccactgcactccagcctgcgcgacaaaagcaaaactctgtctcaaaaaaaaaaaaagaagcataaggatatagctgctatcatatgtgaacaaacacagaatgcttcagatgaatgtaacacatgatgtaatgcctaacaaagagacctctatttgaaatacttggattcattcatttaaaaacaagaaaaaaagattgagcaccttctgtgtgctgaatatagtaaaatagactgaggctgaaaaggcttagctttttcctaagggagtttttagttttatagtatcctcttcaatgaaattatatctgctagtgcatttcccattccagtgaatagctattttttgcattaaaattttattacatgttaaagtttcttccagagtacatgagtggataaactatcttgcctttgaaactcagtgaattaggtagtctgtctttatttcttttaaaatggaatagcgtaacatttttcccttggccaacgttgttgagcagagtttgccaatccattatatgaaagtgagcaacatgtttagtacaaaaagactgatttaagtattggcattgctatgatttattttactgtggtgaaactaacttctctgccaaagctatattatcccactgattacatatatgtgactacttcagtatccaaaggaaattctttgcaatatgcaaatacctttggatgtttgatttcgtctctttagattagaacaaaatttaaaatctgtgatgagttctgaacatttccaaactactcaattgtgttttctttaaaaacaaatataaaacctctctatacaactattttatttaatataagttatagattaagttatatttttaaatgtcacctccaaagaacatttctctttcatttctcctcacttccatagtactatcagtgcagtctgcactactgcattactcattgcaatactcctgtatagtatgtctcaaccatttttaatatgtttgtgttcaaatgcatctaagaaaactgaattgatatgactatgttatattctagtgcttttaacacaccttcatcatcatccttagtctttctttgtctcctcagtttcttttaatttctttgtctccttagttttgcttataccccacatgcggtctcagaaaatcctactagttcttcaaaatgcacacttttttttggaattgactgctgctcaccaactccattgccatcactctaacttaagatataatcatcttttgctgatattattgacatagcttcttagccattgacctgcttctgcttacagtctattctcaacagagaatagagttacactttcaaaaatacattagatcatgtgctgctcttgctctgtattctccagtggctgccaaagacatcagaatctattaaaaggcctaccatgaccagggctccttcagacatgccttgccttgccatctgacttaatgtcctattattatatgtgcatcaggaacactgtttctgaaatgtatcaagcaggttcctgccacagggccttgcacttactattccatgtctggtatgtcctgatacacatttccatgtggcttactgccctttctctttttaagtctctgaccaaatgttatcaaaagttaccctctctgtgagatcttttactaccttattttaaattacatccctccagactgggcatggtggttcatgcctgtaatcccagcactttgggaggcaggcagatcacttgaggccaggagtttttgagaccagcctggccaacatgacaaaaccccatctctactaaaaatacaacaaaattagccaggtgtggtggtgcatgcctgtaatctcagctacttgggaggctgaggcacaagaatcactggaacttgggaggcagaggttgcagtgaactgagatggcaccactgcactccagcctgggcagcagagtgagactctgtctcaaaaaataaaataaaatgaaaatttacatccctccaaatccagcactccccattctcctgttttacttttctctttatatttattatctgaaatatctattttacttgtttcctgttcctcttccccctactaaaatgtaagtttctgtagagcagagatttttgtctgttttgtttatagccatattcatagtatctagaatagtgttgggcaatagtgggaataataaatatttaattggtagaggaaggaagcatagtggataccaaccatgacatgtcctagcagccactaaaatgatcggaattctcctgaaattgtgatcagtttacaactttttctgtgtaggtttttgtacatataattacctcgctccataatttaggagttaaaaacaccgaaaatgcatgttttaaaagtgtcttagtccatttgtgatgctataacaaaatatcacagactgggtaatttataaatagtagaaatttatttttcacagttttggaggctggaaagtctaagatcaaggtgccagcagacttgatgtctggtgaacgcttgctctctgctttaaaaatggcacctcttgctgtgtcttcacatggcagaaggaatggaagggactagccaatccctcaagccctttttttgtttttgaagaggagtctcaccctgtcacccaggttggagtgcagtggcacaatctcagctcactgcaacctccgcctgctaggttcaagcaattatcctgcctcagactcccgagtagctgggattacaggcacccgccaccgtgcagagctaatttttgtatttttagtagagacaaggtttcaccatgtttgccaagctagtttcgaactcctgacctcaagtgatccgcccaccttggtctcccaaagtgctgggattacagatgtgagccactgcacccggccctcaagcccttttataagggcactagtccccttctaataaccactcaagggccccacctgttaataccatcaatgtttggtattaaggtgcaacatggactttgtagggacgcatacattcatatcatagcattaagtcataggatgttttttcctattggaatggaggacgcgctttggtgtcaaatatactagatttgaatcccagcccagctctccattgaatatgcattctgactgctcatgtaaaccattctgagtcatatgtacaatagggataataatatgtcaatgctggccgggtgcggtagttcacgcctgtaattctagcactttgggaggccgaggcgggcggattacctgaactcaggagttcgagacaagcctgggcaacacagtgaaaccctgtctctactaaaatacaaaagaaattagccggtgtggcggcatgcacctgtagtcccagctactcaggaggctgaggcaggagaattgctggaacccgggaggcagaggttgcagtgagccaagatcccgccactgcaccccaacctgggcgacagagttagactccatctctaaaacaaaaataataataatatgtcaatacctaaccattttttacctacaaaagtaatttcatatggctcaacctgaaaataataataacaataagagagcatactcatgttgaatagtgatacaatctattaaatgcctagtataattcctggcccatgatttaaaacagtccataaatccagagagaactgtgtgtgtgtttttaaacatcgtttctattttctgaaacatttattttagataagtaggtataaatgttaagacccacatccagccaacctatgtgcataaatacccaaactacataaagctgcccaagtgcagaaaacaagttcatttttgctttaaaatcgaaactgatggtttttttaaagtgtttgtgaagatgacggtgttcttttaactcattatgaattttaaacaattaaagtattttagttcactacttttggcctccatagtaccatataataggcacttaatagattaatgaattaattatgaggtttctacattaattctgagttgagacatattttgtacttattaaacatgttttaagtaataactcaaagtcatccctcatttgaagtagtccttttatctctggatatgttcaactgttttgaaaaattggctcaattttgcctgtgtcttgattatcactgctgagaggaaaagaaaaatatgtagactgattgttttccacaaaagtaaaatgtgaatttaaaaaggagcatatctatgcaaaattacttaaacacttctcaagcaaaatatctcaagaacgataacatataatgtcccttttagaaattgtgattacccggttcagtgtttcctcaaaagaaactaactatcttgatagaagttaacagattaaatgtgaaagacctatgatttgtttttgaattgactgtgtacaggatcattggtttctttattaacatcactgcatgtggttatttacagcatgtctgtctggcaaaacacagatggtaaatgttatggagagaatttggatttcaggaaaagttgggataatagacaaaaacttataccattatgtgttttcaaatttaaaaagaaagaaaaaaaaatcctgctccaaatgtcattttttttacaattgtacaatttgaattaggaaatgttttccactggagaaaataatgttttggggccgtgagtattttaagtagagtatttttactccatgcctaggccacttcacacagaattatagcattctgattaaacattgtaccacattacacaaagttaagctacacaaaaatgtaaacatattactaaacagtaaagaaatacctctggaaaggttaatggtccgtaatgacagaaaaaataacttacttccaaaagagtgttgtgattttttaagtggtattttgaccaatgtaggaagagtgtgagcatatgagattgtatatttaagtctctcttcaagaaatagaagctcttcactcataatctttataagaagagagaagcctaagaaggaacttagggctatttaaatatatgaagagttaataaacatgaaatgtgtttacctgtcactgagaataaaactaacaaaaacacatttgtttgagatgtgtgtaaacatctgtacctgagttggtattctttaaatctgtactacaattttgtaacaggagcagtgttgtaagttattgaggaatttcatcatctgggttagttaaattaacctcacttcggtaagtgctgtgtggttgtaatctgactatgcaagtgccagcgataacctttgtagtcattctcagtagtcatcctctctgaaacctccaagtcaatattttcatgttatctccagtttttttttaatgtaaaattcttactattgtcttaatctcagttcatataatataaatgcagatttcctaagtgtggaatattaattacttattaagtaacttgaatggtgtctttgaagactgttcatcttttgaaggagtcatactcacaaatatgtatctactatacattaaattttgaaataaattcataatttatggtaatttacatttataatacatgttggaataaatgagaatacataatatgttgttggttctgaaatatatggctcataaatttaatttttactgcagttgcattggttaaactaagaacacctttactggacctgtaaaactgggccccaatattcttttttttttttttttgagacagagtctcactctgttgcccaggctggagtgcagtggcacaatctcggctcacttcaacctccaccacccacgttcaagcaattctcctgcctcagcctcccgagtagctgggactacaggcacccaccaccacacctggctaatttttgtatttttagtagagatagggctttaccatggtggccaggctggtctcgaactcctgacctcaagtgatccattcacctcagcctcccaaagtgctgggattacaggcatgggccactgcacctggccaactgggccccaatatttcaacaagaatttttaaattaattatctaagctgaatttagaggcaaatatcccagagctaaactgattatacagtaccaatgtgaggtatcctttattaaaaagcatgtgttactgtgaatcatttagtaatttctggtatgataggatatttttaacttcccaaagtaagctttaaccaatgtagtaactaagcacggaaatggctcttgggcctacgagtcttatcattgctttcaaatgcatgacgacattggaagagttataggcattcacatgggtacagcccaatggattcttctcatctgctgtacagataaggccaatacactgagacagtgatgttgcagtagagaaacagtttagttattgcagggcatccaagcaggaagacaggacatgtttctgaaatctgcctctctgagaacttggaggcttgggttgttaaggataatttggcaggcagggggctagggaaagggtgctgctgattggttgggaatgaaatcataggtgtgtcagaactgtcttcatgtgctgagttagtttctgggtgggggttgcaggaccggttgagtcagttcctttgtatgagtcacatacaaagggtggcatcagttggttcaccagaatgcaaaagtctgaaaaatatctcaaagaccaatcttaggttttacattagtaatgttatctattaggggtaattgaagaagttatatatcttgtgacctccaggtacatgactcctgatcagtaagcaaactagggaacaatagctggttattgcttaactattcatagatcttagcaaattcaagactctaccataattctaaccttgtggccttttattagttttatgaaggtagtttcagtcctgaacaaggagggggcataattttgggaaaggcctgtaatcatccttgctttaaagttaaaccgtaaagtaaatttctcccatagttggcttggtttacacccaggaatgagcaagggcagttagcttgtgaggttaaaagcaagataaagtcagttatgtcacatttatctcgttgtcgtaatttttgcaaatgcagtttcagcatcactatgtgaatgtgtgtgtggtaaaaatgggaagtataaataattttcctccaaacctaaataagtcttgcaagttgtgacagaccattgtaaatttacacagatttacaatgctgtgccttttcagtccaatggtctgacatctgagaaagctacagtaatcatcaaagttgggcatataggcacacatattacgttgagccctggcctttggatctacaatgccatagatgaatgcaacatactcctgacatatcaagaggttctatcattttttcataattttccaaattggaaaaattctccttaattattttatttgtattataaacttttttccactagttccccacttactgttgactacagatgctttagtagttttaaacaatgaatgggaggagactgattttcccatatgttttgtaaattggcctttcttcttcccacttcactgaagataatctgcccttgcagattatcttttattgattcagggagctatggactggatagtgatggactttgtaatgaaagcacaagctactatttttgcagctgctgaagataagaataagctagaaaacatgaaagtacaatgatcggagatgctgctgcatattcctgtgtagtaaaagatctgctttgttatctggacagtctcttccagaagaagagacttcttgagtcaaaataagataagaagtatgcaacacaaagaagtgaaatgacattcttacagttgaaatattcatactatgttagttggtaaaactgcttagcttctacctcattgaggcaacattggtgtgagaaacactgaaatatgactgagagcctacactagcaagaagatggggggaagatacctttaaaaagatcacttggagttcaataattatggatgcataataacattttgagtactcttaatatagtcagcctagttctttctcaaaaaataaattcaaggacataacagttcagttgatactatggaattttgtttgtttgtttgtttgttagttattcaaaaccagcaaagggatatgatgcttatttggtagagaggacatgctcttcagctctttctgccttcttgatccaagaaagcattcacaaatttaccagtttatttactcaggaaaatgtggctataaatgaatttacccaggaataaactaaattctattatttactaagttcaaatagtatacttttcataaagggatgaaatcagttattgaaaagaagctaaattaattgtaagctaaacaacagcaactgaaatcactgaaagaaattaaaacctactatcatgactgtaaaggattttaaccattctcactttttatatttctagctattaatactgaagggaggacagaatattaacactttgaaattaactctccgccaggcacggtggctcacgcctgtaatcccagcactttgggaggtcgaggcgggcagatcacctgaggtcaggagttcaagaccagcatggccaacatggtgaaaccctgtctctactaaaaatacaaaaattagctgggtgtggtggcaggcacctgtaatcccagctactctggaggctgagacaggagaatcgcttgaacccgggaggtggaggttgcagtgagccgagatcacacctttgcactccagcctgggggacaagagcaaaacttcttctcaaaaaataaacaaataaataaataaataaactcttgacctgaaagatatatgctccgttttgactaatataaaattgattagcagagttagttgaaatcattacagcacccaggggcagctggattgctttcatgaccaaaaaaaaaaaaaaaaaaaaaaaaaaaggccaaaaaggactttccaaatattttaaaactttatgactaattggtctcattgtctcttttccacgtctgaatttttttctttcaagaaaataactgtggccatcaccttggttacacagtggagagaagagatacccttagagaatgcttagaacatctctgatcatgcaaatgtgtaaacttgaatgccaagagactttataatcttaaatctgagcagaggatgtgagtctttgaccagtttcttaaaatctttttcttccatgtcatcaactcttaactggaaatggtaccacacctatgtgattcatggaacatcttaatacttgaaatactcaatggtattcacaatgctgtgctatttctagcttctgcaagtcagctgggggtggcagaatagttacccaattactttaatgtggctagagtgaattctttcacataagcaaatgttctgtgtaatcatagtttctttagactctaaaacatttatttaagtcattttttaatgaaaatctttataaatactttatacctcctttaatttaatagtaaatattttatttccatttccggtcaaaggtaattttaggaataacatgaccatattttactgtaacccgtgatatccttgcaaactaaaaaaaacataaacctatttgtacttattctaaatgatcccaatgctagatctttctgatcttaaagatttgttaattatttattattaggctatagcaatttaacagggctaagactgatattacttcttccccagttaactatcattttgtactatgaaactactctgcattatatagcaaagttcaaagatggtttgaataatttatttattttttttaatcctgaaagcctctagtaattaaagggtgaaaagttgatgttattcaacaggtgacttctggataaaagaggtttacagtaaacattcgtgaatagaaatttagtaattgccatgtcttatatttgaataaaatattaaatcactcaactttagaatctgtgataagtttgattttaaaagccaaaattatgaaaattcctctccccaacattaactgctacatcagtctagtgaagtaaaaataaagtcacagagaaacaagccgctaattgcacagagaatgccaaatataactgaattgataggcacctttttctgtaaaactaccaagagcataatttgtatagttgcctaaaatagtaactattcccaagggttaattttgttaatggcagcatggaaaaagacaataaaaccacggggcacccagttgtgtgaaattgatgtaataattaattacacccttagcctagtaattaagtagtcagtcaccttgccagagtaagttcaaaggcatttaggtggttcatttaagtttatgatttcaaaatattgaagtaaagcactgtgggctggaaaggaacatagatcagtgaattgaacagcagaggggaaccttagccaaataaagctctaaccctggcacagcctctgaatttgctagatgacttgagcaagtcacttaacctccttgtccttcaagtctctgacagccaagtacccaataacctgtaagaaatgtagaaagaaggatttaaattaaatagaactagacatattaagaaagtaaataaatagaattgctaacttaagatgatacaaaaattgttgctatataacaattttaattgcacagcttttgatcattgaataagtgctttttaggcacaattcactaaaagatttcaacatatgacactctgcaaacatcccagtgaagacacatttgcaggtataaattcagtttattttgtggtccaagtttcattgtagtcagctagacctctcaatagggcttatcatcaagtagtttcacttcaatgaactgattaatccaaaatctaaacaactgaaaagctcaagctcaaatactagaatttctttgcactcaaccctcttgaaaagaaatattaaatgtaaacattgactagaagtatctggtttatcttactaaacttttaagattaaatctgctgctattccggcatctgaaatactgcagcctcataaactttggtcctgatgcagactctgaagtatccaaggtgccttctcagcaccgccacatccaaactgctatcatacatgataattgtctacatacttgcatttatctagtgatttaaaatgtacacagtattttatatatattgtctaaccatatactgatatttattcatacatgcatgcatttatggacgttgactcagtactaggtgttcagactataaactggtcaagttctagttagatatatgaacatcccgtgataatgcagtaagatcaaagtaacgtaaagtagctgggtctgaagcacgcaggaagagcaatacagacaaagtgacacttgagcaaggtattgaaaaagattttcaggcagaagagggagagcttctggcagaaggaaaaatggcaggaaaagtacagttatcaaagagccaggactagctgaggaaaggtgagccccttggtgtggctggagaatatataaaagccctagaggacaaaaagtgtcaagagataaagcaggaaaagtaagaagatctttaaaacagagaactttgggcttcagcttctagaccatgagaggagggggactagaaaccttaaaggggtgggggacaatggcagctctgttctatagagtgatgattctgcaacagtgaggagtgagagaggccggtgtgggagacctgggagcaggaagggtcaggaacttccgagagcctgaatcagagtagtggcagtgagcctagagaggaagaaatggctctgagaaagagttggaagaatgtagaatggctaaagatctatgaggaataaaaagaaaggagatagcaaggcttccagtttgggcagctgagtagattatgatgccactatccaagatgagaaattccagagaggcatcagactttgtgagaaaaatactgaggttcattttgggcaccctgggtctgaaatgccaggacaaattcagatgtttagaatgcagttagaaatatgagcatggagcctagaaagatttaaggtctccgagatagagaattggcagtcttcagcatgcggtcagagccagaggagtgaatgagattgccaagagtaaccaaatgaaataattaagaggctaaggatgtatcctgggaaacatcatcagaagtgctaaggaaaaagaatgatccatggaggattggatatggaaacaaagaaagaattgaatccagaagaaaccccaggttttgagctgggagactggcaaaattgtggtttcattagcaaaaatgagtaagtcaggaaaacaaaggagttcgatgatcagttttagacaagtcaaaaagtgttttctgtcattgtcaataaacgataagacatactactttatacttaaattatttccatttgtcaattttatatttcttaaaggctgtctggttatcaccaaataatgtaccatcatatattttaaaaaggtcattggattgggaatcgaaaccaattgagtttgttctggacctactattcattcaaatacttattaaacatttcctatatgccatgcactgtgttatctgctagagatgcaatggtgcagtaccacccttctagagtaatagagaaaactgattaatcggttacatgcaaataaatatgtaaatacaagtgtactaagtgcttttaaaaatcaggtgccagctatgtatgaattcataacatcgcggggacctgacctaacatgaggctcagggaagacttttttttttttttcttttttttgagacaaagtctcgctctgtcaccaggctggagtgcaatggtgcaatctcagctcactgcaacctccacctaccgggttcaagtgattctcctgcctcagtctcccgagtagctgggactacatgtgcgtgccaccacacctagctaaggtttgtacttttagcagagacggggtttcaccatgttggccaggatggtctcttgacctcgtgatccacccgcctcggcctctccaagtgctgagattacaggcatgagccaccgcgcctggcccagggaaggcatttttgaagaaataatagttgaattgagatctgataaaagaagtaggagcaaaatggggggggtgcagttttccaagaagagaagacagtacatataaagggctggtaataggaggcagaatgtccattttgaattggtaaaacaaaggagcaagagtggattggagaagataaagtcaaagagtctgaatgagtctaatgagatgggcagagtccagattacgcaaggttttgtagtctctcttcaggtacctatcctgagagcagtgagaaggttttagaagagttcaaatagaaggttatctgaagagataggcatttaaaaaaaagaaagagagagagagaggtggttgcattgtagagaacagaatagtgaagagcaaaattggttgcagaaacactaaatcagagggctgttacagagcctggacaagaaatgatgggtgcttatacccagagagagtgggggtgaagaggaaaaaaagtcaaaaagaagaggaaggcaaattcaacagaacttaatggattggcttgaggtgctggatttagggagtcaaatatgatcctcaggtttctttctggcttatgcaactgagagatgatcttgccattcaccaaaatggggatccatggaagagcaagcaggcttgtagtggtggaagttcttaagctcagttcagtatatgttgggtttgaggtccatttgagatacccaaatggaggctcaaaaatagccttgacacatagatctgaaggaagagtctagaaaggaggttaacaatttgggagtcattggaatatagatgactatttaaaacactggtgtacacaggactttagggatgcagcatgagataaggagagggactcaaattgagtctttagaaggaattgaagcatttaatatccaggtagagaaggataacatggcaaatgagaatgagaacatgtagaaaagcaagagagttaagtaaaaggagagtgttccaagacaagaaggtgggaaggagtgatcagcaaactccatacctttgggcaatgcgcataatccctttatttatctgttaaaccaagaaataatcactgcattcctgagtattgttatagtaaccaaatctaatgtttgaggaaatgttgaaatctgtaagttgttttattatgtagttactctcagttcttgggttttattttgttttcaaacactgggatcattcacacccttatcttactcttccaggcctcttagaacaagagccaaaaatatatgaatttgaaagggaaaatgttcccaattctttgtgcataattgcatggaaagtaattccactcagaacctggaacatctctcccacttggttttctctttttccttttcctaagaatctagaaatcgccagaaagtactttgtgtcctatgagtataggcttgagcacttcagttctagaaataaacctagtaggtaaacagcttcctgcgattaaatggctagctctggagtggaagaagcttctggtattcagggaacaccttactggtacattctgcattcatcgtggtataattagggacacatcacaagctctccactttgacttttggagtggttatttattacttggtgttcaggaagagggaaggccagatgagaatggaccccctccccacacaacttgtctgtccaagccactgacacagtaactgttcctcaacctcactgctgattgagagtagagctagctaacaccaaaccctcgctcttcctctaggtcagatgctgggcttgtggcaacagttccaacaacaagctgactactatatacaaatgattcatttccagccttctgctttcctttaaagagtcagctgtcatgtgccgcctgtgactcactcaagctcctttgccccagtgaaataagcactctaaagattcctgagttccaggcccctcctaagccaaacgagtcacattgtttttatggtgatacagcacagaagcatcctggctaattcccatttgttgtcctgccagcaaaagcaccatcgtttctaagcataagaagtgagagaaggcaatttgtgttgctttgtttatgcaggacaacccttaagccagttgtggcatgcaaaatacttaagagtgaatgcgtatttccacagtggttcagaaagtaaaagatggccatatacacccgatgattctaattccatattatgcttgtgaggcagtgcagagactttcagaaactttaggaagtgatcctaaactcttcacactctataaactgaagcctaccctaatgaagctccacgaaggacgttgatcttatgctcatttcaaattggccatgttttctaaactgtagtttttcctatcagctgtatatcagaccaaaaaaaaaaatctgttagtttgaaatgaggatttcatgtgagagagaagttttggtggccacatttttataatctcattttctgagatcctcctcacccgtatcccttatattccagaatcgggtcagctgtcattagcttttgccaaatgttcatactgttgagggcacagacagatgaatcacctattgcctaactgaattaagctaaaatgtgtcactggcaggatccttattacaaaatcatgccctgataccacttctgtcactatgttttgctgttgaatgtattattgatattcatcaatcaaatgagcaagggcaagaaatgttttggacttctgtaggagctgtgttatattactttatataaatgaaaagtaattatgtaactaaatatgaattctaacccatatagtgattttttaatattatagaccttgacattgttagcaaccatattatggactaacttaatcacattttataggatagtttattacttgtatttgttatgatatagtctcatatagtctcgatgaagtaaaatgtggtttatagaaaatttatttttaaataatgtcatcacctaggtaacctgaagtttcagagtgaaagtaagcatttaagcttgtggttaaaatctgcttgatgaagatcagattcataaaaaatgcaaactggtttctttagtcaataaagaataaaacctgaggtcagctttcttcgtgatcaatagcctcactacctcagtaagataagatgggaagtaacattttgtgattcccagtctatgttcagtgattttaagggaatatcgcaatattcttaaaatccagtaaaatttgatttctaaaatatttcatgcagtaattttataaataagagaacagtgttctgaaatcaagaaaagtttattagtctcaattgattaaattcacaaacattgagcatctattccataaaagacactgaacaaagctttttaggctatacaagaaaataaaatgttctttgccctcgggaagcttttaagttaacaaggaagacacattacacagtacagaaagtttaataacaatttaaaacaagtaataatgtgttttaaactaaagaaggtatcaagagatagcatatgcataattgccgagtgatacagatgctgcaggctttcaaaaaagagaaagaacacttgaggcagatgtcagtagaaacaaattcactgaatagataggatttgagccaaaccactattaataatttcaccaattatgggctaggaatagaaacaaatcatgattggtgttgggtttgacagctatacctggaggctttcatcttattatctgcctacatctacagtattgattcatatgtcacttcttcaatttgtagagtttactaaaggccatttgtctaaaaacaaaggccagtcacagtgtcggcatccttttgtagagtttgtcaagcagaaaagtgagaaaatgcaaataattatataaagttcaatatctcaatgcaagatatcatctttactctgaagatagacatattattagaatgatactttttaagattgtttttaataacacttgttaactatgaagagaaatatgtttactaatccaatcaagttaaggtagtaaaaactaattttattttattttattttatatttatttatttatttatttatttatttttgagacggagttttgctcttgttgcccaggctggagtgcagtggcgtgatctcggctcactgcaacctccacctcccaggttcaagcaattctcttgccacagccttcccaagtagctgggattataggcatgcgccaccaagcccggctaattttgtatttttttttcagtagagatgaagtttctccgtgtgggtcaggctggtcttgaactcctgacctcaggtgatccgcccacctcggcctcccaaagtgctgggattacaggcatgagccactttgcccagccttagtaaaaactaattttaaaaaacatagccttgaccgacctttcaggtgactgttgttttcaaacaaatggaaaatagcagtgctttccaaacatgaatgtactcagaggtcacctgagagtcatgttaaaatgcagattctggcagggcacagatcacacctgtaatcccagcactttgggaggcagaggtgggaggatcacttgagcccaggaggtcaaggctgtagggagctgtgattgcgctactgtactccagcatgggtgacagagtgagaccctatctcaaaaattaaaaatgaaaaagaatatttaatatgacttttgtcttttattcttacccaactccatatttttgcctttagcacgaaagcaagagattatcaaagtcactgaacaactgatcgaagctatcaacaatggggactttgaagcctacacgtgagtagcggacgtttactttgctttcatgcatatggtaaatatattttttatatgaatgcattattcaacatgtctgaattcacatatatttaattcaaggtttgatatgttaacaatagttttatttcataaatgactaagtgcccctaggagagaaaaatttcagagaaaatttcagagaaaagatttcagaggccaggcacagtggctcacacctgtaatccttgcactttggaaggccaaggtgggaagactgcttgaggccaagagttcaagaccaacctgggtgacaaaacaagaccccgtttctacaaaaagtttaaaaattagtcaggcatagtggtgcacacctgtagtcccacatacttgggaggctgaggcaggaggatcacctaagcccaggaggtcgaggctgcatggagccatggtcacatcactgcactccagcctgggtgacagagtgagaccctgtctcaaaaaagaaaagaaaaaagatttcacagagagaaggcttgacttctgatccaacgattggagatttctttgtaaatatacagatgtataaccactcccacatcacacatacagaagtccagatgagaaaaggtcagtccaggcagagcaattcatgtgagcaaacacacaaaaaaatatgaaagtacataaaatgtgcatttcagcttaagaaatgttttcccttgcagttctgcagaggttctggggcagagaaagagattaggaggtgacatgaggcagccttctctcttcagccagtacagctcaactttatctgcatctcttttatatgtttgtatcttaaggaaaactttacttgaagaatgggttttaatgcttatttaaagtttataaactcctggatcataggaactatgaaggaaattactttgctgaagttaaaataaagcattcaatttaaatagggccttctccttacaccatgcaactaatgagttccaccccagtgaaagacttaaaatgcaaaacggagattgaatctgatctctggctagaaagatccaaaagctgaagatataatcataaatgagaacataatatgattatacctaaatagataaaacgtgtatactttaattaaaaaaccaagaataaaagagacaaacttagaaaaacatttgcaaaacatatatcaaaatttaattttttatattgcgtgaatatgattgaaaagtagaaaaataggtaaagaacatgaactgactattatcagaggaggaaatataaatgacaagtaaactagtaaaggcatattcatgtttactaattaagtatacacaaacttgaatgcaagagcctcttctccctataaagtcagcagagatgtaaattctgctgatagccagcaaggtgcagatactgcaggacaatggtgactttcctccaccatggaataaaacacaattgggtgcaaactttcagggtggtggtggtggcagatatggggggattagtaatatattttgttgtataatctgttattatatacctgaaagcttttataaagtctcactttactgtaatactataattctacttataagaatttaacaagtataaattttttatgtaaaacatgaacaaaaatttgtgaacaaagatatatactgaagcaaaattcataatagtgaaaaattggaaacaatgtatatgcccaacagtaccattcccattaaatcatctttggtacaatggttatgttgagtttctagcgacctggaaaaatatttatgatgtttttactgaaaattaagcaggacttaaaagactatgtacataattattacaactaaaaaagtaaaaggtattaaaagtgccaggtgcgatgtctcacgcctgtaatcctagcgctttgggaggccaaggcaggcagatcacctgaggttggaagttcaagaccagcctgaccagcatggagaaaccccatctctactaaaagtacaaaattagccaggtgtggtggtccatgcctgtaatcccagctacttgggaggctgaggcaggagaatcacttgaacccaggaggcagaggttgcggtgagctgagatcgcaccattgcactccagcctgggcaacaagagtgaaactctttctcaaaaaataaacaaataaataaataaaaagtattaaaagtggaatgaaacatgccaaattagattttaaaaagaaaaaaagaagttgcctctgagaggtaaaattatgtgtgaatttttttcctgcttttttattcttcccaaattttacataagcaagtattacttttatcattagttataaataaacacaaaatataaaatatggacgagattagctaaatgtaagacaaactatatcaggagcttcttcttataacttaaatatgtgtgcatatatgtataaacacatgcatatacttatgtatgagtgtatccattctttatcatgacctaataagacatacttggaataaaagaaatagtaaaaattggagttaagaagaagtctgttttcagagacaaccgttccctattaaacaattgtttatagctgtgccatagaacctgctttttaaaaattcttgttgctgttatatccttgttagatacatatgattatccaaagaataagattattctcttttttaaaaaatcttttttttttgcaatagcatttccttgtggaatgataaaaagttgtgtttgttattgttaaaaagaagttgcctctgagaggtaaaattgtgtatgaatttttttcctgcttcttttatattctttctaaatttataaacagatactactgttatatagggagcaattgtagccaggcaaaagtgtatgtttcctatattctcagtttaaaatagggtattttaaataatgctaaaccttgggatcataccagttcactaatatctttgcctatggagacttataatctggcctgattttgtactttccagccagagctaatccaacagggcttccattcgagagcttttgggatggtagaatgtactggtggatccctgtcagctggtccttagaacacctgttcagatcacacacacccacatgtcaaatggcagctttgtggatctttcattaatacaaagccttttatggggtagatggatgattagatagatagatagatagatagatagatagacagacagacagacagacagacagacagacagacagacagacagacacacacacacacacacacacacacacatttccaaatatactgactctttttcatggctgggtaagaagatccatcatggcacagtgattcccagattatgttagtactgatgtaaggcagtaagaaattttggttcactgataatgacaaccaaaaaccatatttatagaggaagtaatagcccctggcagaataaattcttgttaccataggaacgctgttcttcccattttgcttcttagaaagagactatatatatttgattttaagcttaaaaatgcctgcccagcaggcaatctgaagtgaaggttactgtaatccttgcccccatcatctttaaggcacaaaggatatccactgtgatttctactttttaaaggtattctttaaataacaccggttccacgttctataaacagtactgcactttgaggaactacagtgagttagacttttgaaatttgtatttctgttgaacatttaaaaaattttgctccccctccacccaaatggggaatttctctatgaaattagatgtggccccatccactgtattaccctttggggcaaattaataaacagtccaaaatcctttgatttgtactccatttgatctaccttgtgaactcccattcattcttcaaatccaggtcttgtcaccttctctgagaagcctaccctgatcaccataggcccaaaggaaatattttcttctctgcatttccaggggccttacacacataacacagtgaccctgctttccatatcaagcaaccagtcatcattccccaagcatactctgcattttcacagcagcagaccattgcacttgctgtcctccccctgcccaccacctcccacacacctggaaaactcttactcattcttcaaagcccagctcaaattttcttcctctcttaaacctttcctgttcatctattctagtattgattattgtataattgcttgttttgaagaatatctgccacatagtaagtgttcagcaattctttactgaataaataaatttctccaaagaaagctcattggttttttccaaatatttaaaattgtgcacccctttattgaatcatatttctaggattaagaaagaaaaccaatatgagcatttgaaccttctgttgatttcattttaaaaataaaataaacttaaacacaataataagatgtaagtcttgtggacattgccaggaagtgtagggtgtgatactttctttcaagtcaattgtaatatacatgtttgacatgaatgtaggatatgtggtccatcaaaaattattccaaggctaagcatggtggatcacccctgtaatcccatactttgggaggtcaggtgggaggatcacttgtgcctagagtccgagacgagcctgggcaacataaggaaaccccatctctactagaaataaaaatttaaaaattaacccagcatggtactgtacgccaatactcccagctactagggaggctaagccgggaggattgcttgagtctggaaggttgaggctgcagtgagccatgattgcaccaatacactccagcctgggcaatggagcaagaccctgtctcaaaaataataataattattattattattattgcagaagtatttaatttcagaatcaaagatagttttataggatttggagagtgtcttacacttggacaataggacttggagagcatttttaaaaaatagtaaacctcaatcaagagttagaaaaactggaaaattcaccttaaaaataaaaaagtagaaattataaaaaggggcctcctaaaatattgtgtattatcatctgcttgaactggataaattagtttgttcctatcagagttctctgcaaaatgtctttttaagagtctgctcctcaacccaccttgccaaggtttatgatagaacttttgtatgtaagtgtttttagaggctctttccttcagtgactggtaaatcagaatgtttacacatgaaacaacaaaacacattaaagcacctattaattggttgttttcattatttttcttttacagaaaaatctgtgacccaggccttactgcttttgaacctgaagctttgggtaatttagtggaagggatggattttcaccgattctactttgaaaatggtacatttattcctaatttaataacatgccctttttaaacctctctgaattttcccaaatttgcagattattttgctcttttctacaatgagagtttttaccttcatccagcatttgaaaccatacaatggttttgtattcaaaattgaaaaaaaaatatgtcaggcttggcttacagttttggtgtgttttaaaaaatatctttgtaaaaaaattaatgttgactgggcactgtggctcatgcctgtaatcccagtgctttgggggccgaggcgggtggatcacttgaggtcaggagtttgagaccagcctgaccaacatggtaaaggctcatctctactaaaaatacaaaattagctgggcatggtggcgcacacctgtaatcccagctacttgggaggctgaggtatgagaattgcttgaacccgtgaggtggaagttgcagtgagccaagatcgcaagcctgggcaacaagagtgaaactccatctcaaaaaaaaaaaaaaaaagtaatgttgattgaatacacttcaagcaagttgcagttaatgtataatataagctataaagcagttacaaaaaatgttatttcacattttcataaaactatatataaaaaaattaggcaggcacgctggctcatgccagtaatcccaacactttaggaagctgaggtggcaggatagcgatagtttaaggccagaaattcaagaccagtatgagcaacatagtgagaccccatctctacaaagaatataaaaattaaccagtcatgatgacaagcacctatagtcccagctacttgggaagctgagatgagagatcactttgagcccaggagattgaggctgcagtgagctataatcatgccactggactcctgcctgggtgacagaacgagaccctgtctcaaattttaaaaataagaaaaagaaaaaataggaggaaaaaatttttaaaaaccacaccatgccaaaatatttaacatagaagagtgctttcaagcatatgtgatgcttattttcaaagtaaaatgaaaatgaaggtgagtaatcagataaatctttcaattcaaattttaagacttgtggtagtttcagaggaaacagccacttttcaaagaaggtgacaaaagaagttcatcctgcagaaatccttcaggtcatcaagaaaaatgtaaaccaggaattccctttatccttctctttttccttacacctaatgacattagacattatgctgtgtttgcatcttgcattaagggaatttactatttttgcagagatcttattgaattaaaaaagaaatgtattataggaatgattaggataatcacatcactttcagtaattataagctttgataagaatgtctgccttggcatggattttcgaattaagatgtgttggatgagttactttttcttatatgcattagacatttacaaacaaataaacaaaaagaactatttgataaattctctttaacaaaatttcagtaaatgttatcatattccctatattccagtgttctgatagcatctcatgtttcctccaactaactctctatcgacaccatctgatccctaatgaaagaattaactcattaatattttaacctatttcagtataacactatatatcatgttccataaatataattccttcataatggggtatttaggtgactataataatattttatataatttgaatagatgttttctgagaatggaaagcatgtttggataatagccaaaaacaattcaaccttttctagtgatctaagaaagaaacagcatcaataagtgatgtgcactaaatcctcctcgtatctcttggtgactgaataattagaattggtaactactgtcaaaaccagaggctggagcatagtgagggctactcagtcaagggaaagagctggaagaccagaatcaggctatgtgccaacaccacattttgaatgtttatcagatgatcacagtggactatcatggaatggactctagtatgtggaggagtcagagaatgagatgagaaacaagttcataggcttgttcaaaggctaccaccagccttattttgaagacagtgatgtctatacctgaaacttgatatatttcccttctcccacatacttcaccaactaacaaaaacaaccaccaccacaagatccctggtcagctgtcccagcagttcattcctggaaaagacaggggcagtgcttggcacacctgggccaggccttcttcacttctattcatgttgtgatttctgtttctaaccactttccattgtaaataaatatatctctccagctttttcacccaatcaaaatttccagagagcatataaatgcctgtaaaggaaaccagataaaataaagactgtatccactttcattctttttttgctttgtacagtgcccagtacccaattagtacaaatagtagattaattaactaattaattagtgagtgaataaatgtcatttcattcattggtcctaactgaagttattactggttttagtttcctttacatagaaactaaattttgcttttcatgtttttctctttcagctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtttatgattctctggaaagatcaatcagatcagccatttgtgggttgaaacttgctatagagcagtatatgataggtttagacaggacgagagactacgtgatcaaaatctcacagggttaaatctagaggacttgtataataaggcaaaatatttgtgacttcatcttctcaattgacagaagaaggggatatcagaggaaaacatagggaggagtttctaaaatggccaatatattatcaggagtttcatttcatagatgatcccctaaagctcagttagagagacagcatttaaaaggccattgtcaggtagtgcaatgtcattctcacctcaccactctacctcagatatcatttgcttttccagtcagcgattaggcacatatttattgtgaatcacctaggtgcttaatctgtgccagattcaacacaaagtacaagatattgctttcaagaaacatgtattctcatttagccaatcattgattctaaagaaaaaaatgatataataaagtttatcatcaacttcagaatacagtagagttaatgaacagtgtagtaaactgtttataacagtttggaagtacactttgtatataagatagaattttggacaaaatcttaaatgatgagtagaatttagagacatagactgaaaaagcaaaggaggatggatagtccaagctaaatgagcatcatgaagaaaagtacaatatcaggatttagtttaatatgatagaacattattggtaaggaaggccggttacaactaaagaggaataattgaaaataggcttattggtaaagtggagtgagatgaaaacaagaagagtttaaactcagtgtagaagttgggtccactgttgatctctttccaaattctctcaccaggatcacctgttaatatttgagatttggaatgggggttcatacaaacagccattcaactcactccagagaatccatcatgatttcttagtttggtagcataccacagtggttttcagaggccttctgtatagccttaataattatatatcactgttagatttgtaaaaagtgggtcaacagggacaaaaatcaaaccaaaccaaacaataggctgaaatttattcccaaaaccatagctatgtaattaagagaaaaacacaagaggaatatgaagataatgaagacacccgtttttgtgtgtttttcaccccaaagaggtacagcacaaatcgccagttaatatagaaggggttacattcatacagtaccaggggtttaggtttttttgcagttccctgaagtgtttatgggatgaagcctattcaagaaaacttcattttatgccaggtggcttaaatggggcttctcttaataggccaccctgtattccaaatgggaaagaaaacttctcaggaggcacctctttgtggcaaaacatctaaggcctgaaaaccattcacatatgggtcttgtaagtaacatcctgctccgtgatactttgtgactggagctgaatgaaaagctgcatggctgttttccttccttttgaggatattttttattgcataatattcaatgaaaaacgcacaaggtctttgaaaattcatagcaattttgcatgagcttttgaatctaacattcagccctatttggtagcataatccttattttaaaggtaataaacactgaaaagaattttttccaacatgtggattgtgtcatgttagaatcctgaagttttcacatcaaaagtaaattatgtctgggtcagttcagataactctcaattatccggacttaatttatattaagctttagaatcctttggtgtcttaaccattctttcaagaggttgcagttctgtaagcagctggctatggcgaatgtgtaaatcaatttgctgtgcctgactgagtataatggtacttgaccatgaggacaggccacaggaggaagtcaagctgaaatttaaaactcacaaaatgggtaattccagaggataattgaaagttgactgtaattaacttcatgcttttgttgttgtttttaattaattgtttcttagacttgggttacaagcattcagatatgtatggtgctgttgtgaatatttgcctcattcagagaactaaaccttatcagagcttttaacaaatagtgctcccagctgttgctttcagcaaaggagatctccaattaaagagagtaatcatgttctctctactttcgagactatattccttgttaaattgacttctaggtttcatttcccaaggaatctaacaataataacagaagctaaggatgaacttgaattttaagtctatttcaacaaaaggattatattcatttactaatttgtccagtaaacaggaatgcttaagatgtatacttagatttaataatgtgactgaagactgtgtctctgtctctttatttttagcttagctttgtgtgaaaaaataattaatactgatcttctaatttaatactctctttgtgtaacattgtatgtttcttcttgtaatgatcacaagcaaacatctcttatacatagtgttttcaatctatttgttagccaagttataaaactgtagcctagtcaaatctatggcaaagcaatttgatgatattttgtaaaacaatataatttatttcttcctccccctttctcctttcagctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 2 - DNA, 5872 bp, Homo Sapiens
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 3 - protein, 499 aa, Homo Sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 4 - DNA, 15 bp, Artificial Sequence
  Antisense Oligonucleotides
cgaaagtagctcgcc

SEQ ID NO: 5 - DNA, 16 bp, Artificial
  Antisense Oligonucleotides
ccgaaagtagctcgcc

SEQ ID NO: 6 - DNA, 14 bp, Artificial
  Antisense Oligonucleotides
cgaaagtagctcgc

SEQ ID NO: 7 - DNA, 15 bp, Artificial
  Antisense Oligonucleotides
ccgaaagtagctcgc

SEQ ID NO: 8 - DNA, 16 bp, Artificial
  Antisense Oligonucleotides
tccgaaagtagctcgc

SEQ ID NO: 9 - DNA, 17 bp, Artificial
  Antisense Oligonucleotides
gtccgaaagtagctcgc

SEQ ID NO: 10 - DNA, 15 bp, Artificial
  Antisense Oligonucleotides
tccgaaagtagctcg

SEQ ID NO: 11 - DNA, 16 bp, Artificial
  Antisense Oligonucleotides
gtccgaaagtagctcg

SEQ ID NO: 12 - DNA, 15 bp, Artificial
  Antisense Oligonucleotides
gtccgaaagtagctc

SEQ ID NO: 13 - DNA, 17 bp, Artificial
  Antisense Oligonucleotides
tggatatagggcaaggg

SEQ ID NO: 14 - DNA, 16 bp, Artificial
  Antisense Oligonucleotides
agaatgatggtgagcg

SEQ ID NO: 15 - DNA, 17 bp, Artificial
  Antisense Oligonucleotides
aggaattgggtttgggt

SEQ ID NO: 16 - DNA, 19 bp, Artificial
  Antisense Oligonucleotides
aagaggaattgggtttggg

SEQ ID NO: 17 - DNA, 20 bp, Artificial
  Antisense Oligonucleotides
gagcacacattattaatcaa

SEQ ID NO: 18 - DNA, 20 bp, Artificial
  Antisense Oligonucleotides
attgattttagtggattgcc

SEQ ID NO: 19 - DNA, 20 bp, Artificial
  Antisense Oligonucleotides
cctggaaaccaataattagc

SEQ ID NO: 20 - DNA, 19 bp, Artificial
  Antisense Oligonucleotides
cctggaaaccaataattag

SEQ ID NO: 21 - DNA, 20 bp, Artificial
  Antisense Oligonucleotides
ccctggaaaccaataattag

SEQ ID NO: 22 - DNA, 18 bp, Artificial
  Antisense Oligonucleotides
cctggaaaccaataatta

SEQ ID NO: 23 - DNA, 19 bp, Artificial
  Antisense Oligonucleotides
ccctggaaaccaataatta

SEQ ID NO: 24 - DNA, 18 bp, Artificial
  Antisense Oligonucleotides
gataattttggcagcata

SEQ ID NO: 25 - DNA, 19 bp, Artificial
  Antisense Oligonucleotides
tgataattttggcagcata

SEQ ID NO: 26 - DNA, 20 bp, Artificial
  Antisense Oligonucleotides
ttgataattttggcagcata

SEQ ID NO: 27 - DNA, 18 bp, Artificial
  Antisense Oligonucleotides
tgataattttggcagcat

SEQ ID NO: 28 - DNA, 18 bp, Artificial
  Antisense Oligonucleotides
ttgataattttggcagca

SEQ ID NO: 29 - DNA, 17 bp, Artificial
  Antisense Oligonucleotides
gttgataattttggcag

SEQ ID NO: 30 - DNA, 18 bp, Artificial
  Antisense Oligonucleotides
gtgttgataattttggca

SEQ ID NO: 31 - DNA, 20 bp, Artificial
  Antisense Oligonucleotides
tggtgttgataattttggca

SEQ ID NO: 32 - DNA, 19 bp, Artificial
  Antisense Oligonucleotides
tggtgttgataattttggc

SEQ ID NO: 33 - DNA, 20 bp, Artificial
  Antisense Oligonucleotides
ttggtgttgataattttggc

SEQ ID NO: 34 - DNA, 19 bp, Artificial
  Antisense Oligonucleotides
tttggtgttgataattttg

SEQ ID NO: 35 - DNA, 20 bp, Artificial
  Antisense Oligonucleotides
tttttggtgttgataatttt

SEQ ID NO: 36 - DNA, 19 bp, Artificial
  Antisense Oligonucleotides
tttttggtgttgataattt

SEQ ID NO: 37 - DNA, 20 bp, Artificial
  Antisense Oligonucleotides
ctttttggtgttgataattt

SEQ ID NO: 38 - DNA, 19 bp, Artificial
  Antisense Oligonucleotides
ctttttggtgttgataatt

SEQ ID NO: 39 - DNA, 20 bp, Artificial
  Antisense Oligonucleotides
gctttttggtgttgataatt

SEQ ID NO: 40 - DNA, 18 bp, Artificial
  Antisense Oligonucleotides
ctttttggtgttgataat

SEQ ID NO: 41 - DNA, 19 bp, Artificial
  Antisense Oligonucleotides
gctttttggtgttgataat

SEQ ID NO: 42 - DNA, 20 bp, Artificial
  Antisense Oligonucleotides
agctttttggtgttgataat

SEQ ID NO: 43 - DNA, 18 bp, Artificial
  Antisense Oligonucleotides
gctttttggtgttgataa

SEQ ID NO: 44 - DNA, 19 bp, Artificial
  Antisense Oligonucleotides
agctttttggtgttgataa

SEQ ID NO: 45 - DNA, 20 bp, Artificial
  Antisense Oligonucleotides
aagctttttggtgttgataa

SEQ ID NO: 46 - DNA, 17 bp, Artificial
  Antisense Oligonucleotides
gctttttggtgttgata

SEQ ID NO: 47 - DNA, 18 bp, Artificial
  Antisense Oligonucleotides
agctttttggtgttgata

SEQ ID NO: 48 - DNA, 19 bp, Artificial
  Antisense Oligonucleotides
aagctttttggtgttgata

SEQ ID NO: 49 - DNA, 17 bp, Artificial
  Antisense Oligonucleotides
agctttttggtgttgat

SEQ ID NO: 50 - DNA, 18 bp, Artificial
  Antisense Oligonucleotides
aagctttttggtgttgat

SEQ ID NO: 51 - DNA, 17 bp, Artificial
  Antisense Oligonucleotides
aagctttttggtgttga

SEQ ID NO: 52 - DNA, 17 bp, Artificial
  Antisense Oligonucleotides
gttgaaaatacccaccc

SEQ ID NO: 53 - DNA, 20 bp, Artificial
  Antisense Oligonucleotides
tttaaaatatagttattcat

SEQ ID NO: 54 - DNA, 18 bp, Artificial
  Antisense Oligonucleotides
ttatgtcaacagctattt

SEQ ID NO: 55 - DNA, 18 bp, Artificial
  Antisense Oligonucleotides
atttgcaataaatatgga

SEQ ID NO: 56 - DNA, 17 bp, Artificial
  Antisense Oligonucleotides
ctgtggagtagagacta

SEQ ID NO: 57 - DNA, 20 bp, Artificial
  Antisense Oligonucleotides
taggtagttctttgaagcag

SEQ ID NO: 58 - DNA, 17 bp, Artificial
  Antisense Oligonucleotides
gtaggtagttctttgaa

SEQ ID NO: 59 - DNA, 20 bp, Artificial
  Antisense Oligonucleotides
gtaaaattgacacaatactt

SEQ ID NO: 60 - DNA, 17 bp, Artificial
  Antisense Oligonucleotides
tgaccattttgaaggaa

SEQ ID NO: 61 - DNA, 19 bp, Artificial
  Antisense Oligonucleotides
gatttattttcagtatttg

SEQ ID NO: 62 - DNA, 17 bp, Artificial
  Antisense Oligonucleotides
tatggtatgtatgacta

SEQ ID NO: 63 - DNA, 18 bp, Artificial
  Antisense Oligonucleotides
actttatataatttgaca

SEQ ID NO: 64 - DNA, 20 bp, Artificial
  Antisense Oligonucleotides
ttcttggactttatataatt

SEQ ID NO: 65 - DNA, 18 bp, Artificial
  Antisense Oligonucleotides
ttcttggactttatataa

SEQ ID NO: 66 - DNA, 17 bp, Artificial
  Antisense Oligonucleotides
gtagcaagaattagttt

SEQ ID NO: 67 - DNA, 17 bp, Artificial
  Antisense Oligonucleotides
ttaatatcaagacctat

SEQ ID NO: 68 - DNA, 17 bp, Artificial
  Antisense Oligonucleotides
ctggaagtgtggatata

SEQ ID NO: 69 - DNA, 19 bp, Artificial
  Antisense Oligonucleotides
tgtaacttaaaatctttaa

SEQ ID NO: 70 - DNA, 20 bp, Artificial
  Antisense Oligonucleotides
tagtactttattcatgcttg

SEQ ID NO: 71 - DNA, 18 bp, Artificial
  Antisense Oligonucleotides
tttctttaaatcaatact

SEQ ID NO: 72 - DNA, 18 bp, Artificial
  Antisense Oligonucleotides
aggagttaaaatgagact

SEQ ID NO: 73 - DNA, 19 bp, Artificial
  Antisense Oligonucleotides
aatgggaagataaaatgta

SEQ ID NO: 74 - DNA, 19 bp, Artificial
  Antisense Oligonucleotides
aaccattttcctaccattt

SEQ ID NO: 75 - DNA, 18 bp, Artificial
  Antisense Oligonucleotides
tgtatagtgagatatttt

SEQ ID NO: 76 - DNA, 17 bp, Artificial
  Antisense Oligonucleotides
aagtagggagaatgttc

SEQ ID NO: 77 - DNA, 18 bp, Artificial
  Antisense Oligonucleotides
ctaatatatgagaagtaa

SEQ ID NO: 78 - DNA, 20 bp, Artificial
  Antisense Oligonucleotides
ttcatgctttatttcaatgt

SEQ ID NO: 79 - DNA, 20 bp, Artificial
  Antisense Oligonucleotides
gaaattcaaattatccagaa

SEQ ID NO: 80 - DNA, 19 bp, Artificial
  Antisense Oligonucleotides
agagttcaaattgggatgg

SEQ ID NO: 81 - DNA, 20 bp, Artificial
  Antisense Oligonucleotides
agaaaagagagttcaaattg

SEQ ID NO: 82 - DNA, 20 bp, Artificial
  Antisense Oligonucleotides
ttattcaaaatacaacctca

SEQ ID NO: 83 - DNA, 17 bp, Artificial
  Antisense Oligonucleotides
tattaattactgtgcca

SEQ ID NO: 84 - DNA, 20 bp, Artificial
  Antisense Oligonucleotides
agaaaatactgaattataca

SEQ ID NO: 85 - DNA, 18 bp, Artificial
  Antisense Oligonucleotides
gtagaatggatcaaaatt

SEQ ID NO: 86 - DNA, 20 bp, Artificial
  Antisense Oligonucleotides
gaataggtattagaaatatg

SEQ ID NO: 87 - DNA, 20 bp, Artificial
  Antisense Oligonucleotides
tattttatgatatgattatt

SEQ ID NO: 88 - DNA, 17 bp, Artificial
  Antisense Oligonucleotides
ttgcagtacatagggaa

SEQ ID NO: 89 - DNA, 15 bp, Artificial
  Antisense Oligonucleotides
ctcgcatactttgtc

SEQ ID NO: 90 - DNA, 19 bp, Artificial
  Antisense Oligonucleotides
taattttacttgactttac

SEQ ID NO: 91 - DNA, 17 bp, Artificial
  Antisense Oligonucleotides
tacttagtcactcttaa

SEQ ID NO: 92 - DNA, 18 bp, Artificial
  Antisense Oligonucleotides
atcttagttttggatttg

SEQ ID NO: 93 - DNA, 20 bp, Artificial
  Antisense Oligonucleotides
atttaaatcgaagttgtctt

SEQ ID NO: 94 - DNA, 17 bp, Artificial
  Antisense Oligonucleotides
tagggaggctaaatatt

SEQ ID NO: 95 - DNA, 18 bp, Artificial
  Antisense Oligonucleotides
tggacattatgattatca

SEQ ID NO: 96 - DNA, 18 bp, Artificial
  Antisense Oligonucleotides
attgggagattatggaca

SEQ ID NO: 97 - DNA, 20 bp, Artificial
  Antisense Oligonucleotides
tttggtttggattatttcaa

SEQ ID NO: 98 - DNA, 18 bp, Artificial
  Antisense Oligonucleotides
tggtatttctaagtttag

SEQ ID NO: 99 - DNA, 18 bp, Artificial
  Antisense Oligonucleotides
ttcctcattaatagtaga

SEQ ID NO: 100 - DNA, 20 bp, Artificial
  Antisense Oligonucleotides
actttcttctgatactgaag

SEQ ID NO: 101 - DNA, 17 bp, Artificial
  Antisense Oligonucleotides
cctcaatgttacctttc

SEQ ID NO: 102 - DNA, 18 bp, Artificial
  Antisense Oligonucleotides
acagttttatagataaga

SEQ ID NO: 103 - DNA, 16 bp, Artificial
  Antisense Oligonucleotides
tatcctaaactagccc

SEQ ID NO: 104 - DNA, 18 bp, Artificial
  Antisense Oligonucleotides
aatgtgctaggttctgag

SEQ ID NO: 105 - DNA, 18 bp, Artificial
  Antisense Oligonucleotides
agtcattaattctttatc

SEQ ID NO: 106 - DNA, 18 bp, Artificial
  Antisense Oligonucleotides
tgtaagcaaggcacaaga

SEQ ID NO: 107 - DNA, 17 bp, Artificial
  Antisense Oligonucleotides
acacctacctcaataac

SEQ ID NO: 108 - DNA, 18 bp, Artificial
  Antisense Oligonucleotides
caatataagacatgagag

SEQ ID NO: 109 - DNA, 17 bp, Artificial
  Antisense Oligonucleotides
cttatctatccaaatgc

SEQ ID NO: 110 - DNA, 18 bp, Artificial
  Antisense Oligonucleotides
atcctatcacattacttc

SEQ ID NO: 111 - DNA, 19 bp, Artificial
  Antisense Oligonucleotides
tgttctattttattagtac

SEQ ID NO: 112 - DNA, 19 bp, Artificial
  Antisense Oligonucleotides
gagaggtaagaatgatgaa

SEQ ID NO: 113 - DNA, 18 bp, Artificial
  Antisense Oligonucleotides
ctgggtttgagggagagg

SEQ ID NO: 114 - DNA, 19 bp, Artificial
  Antisense Oligonucleotides
tcctttgtatttcttgaat

SEQ ID NO: 115 - DNA, 20 bp, Artificial
  Antisense Oligonucleotides
ataggttgatgtttctttga

SEQ ID NO: 116 - DNA, 17 bp, Artificial
  Antisense Oligonucleotides
taataggttgatgtttc

SEQ ID NO: 117 - DNA, 17 bp, Artificial
  Antisense Oligonucleotides
gccaaattctttctagt

SEQ ID NO: 118 - DNA, 20 bp, Artificial
  Antisense Oligonucleotides
aaaataaataacacatccca

SEQ ID NO: 119 - DNA, 20 bp, Artificial
  Antisense Oligonucleotides
ttttaatgtgttattatcct

SEQ ID NO: 120 - DNA, 20 bp, Artificial
  Antisense Oligonucleotides
gacctaaatattatacaaga

SEQ ID NO: 121 - DNA, 18 bp, Artificial
  Antisense Oligonucleotides
tgaagaatctaaatatgt

SEQ ID NO: 122 - DNA, 17 bp, Artificial
  Antisense Oligonucleotides
atcatctggttgtgaat

SEQ ID NO: 123 - DNA, 20 bp, Artificial
  Antisense Oligonucleotides
cttaatgaatatagagttct

SEQ ID NO: 124 - DNA, 18 bp, Artificial
  Antisense Oligonucleotides
acttaatgaatatagagt

SEQ ID NO: 125 - DNA, 18 bp, Artificial
  Antisense Oligonucleotides
ttaataatcatatatacc

SEQ ID NO: 126 - DNA, 18 bp, Artificial
  Antisense Oligonucleotides
cataataatagtatttgg

SEQ ID NO: 127 - DNA, 20 bp, Artificial
  Antisense Oligonucleotides
aataagaatttccataactt

SEQ ID NO: 128 - DNA, 17 bp, Artificial
  Antisense Oligonucleotides
gagatcaataaagtata

SEQ ID NO: 129 - DNA, 19 bp, Artificial
  Antisense Oligonucleotides
atttgaaaggctgatggga

SEQ ID NO: 130 - DNA, 18 bp, Artificial
  Antisense Oligonucleotides
atgtaaatcaaatagttc

SEQ ID NO: 131 - DNA, 20 bp, Artificial
  Antisense Oligonucleotides
gaagagtaatttaaaagctt

SEQ ID NO: 132 - DNA, 18 bp, Artificial
  Antisense Oligonucleotides
ttgacatctgacttttaa

SEQ ID NO: 133 - DNA, 17 bp, Artificial
  Antisense Oligonucleotides
agatatagttacttaac

SEQ ID NO: 134 - DNA, 17 bp, Artificial
  Antisense Oligonucleotides
gtcaagttatcaggtat

SEQ ID NO: 135 - DNA, 20 bp, Artificial
  Antisense Oligonucleotides
gacagagactgaaatgataa

SEQ ID NO: 136 - DNA, 17 bp, Artificial
  Antisense Oligonucleotides
ctggagaagttttgaag

SEQ ID NO: 137 - DNA, 19 bp, Artificial
  Antisense Oligonucleotides
taaaagagtttgcatagga

SEQ ID NO: 138 - DNA, 17 bp, Artificial
  Antisense Oligonucleotides
aatattattggttgagc

SEQ ID NO: 139 - DNA, 18 bp, Artificial
  Antisense Oligonucleotides
tctcataaacttcattcc

SEQ ID NO: 140 - DNA, 18 bp, Artificial
  Antisense Oligonucleotides
cctctctcataaacttca

SEQ ID NO: 141 - DNA, 20 bp, Artificial
  Antisense Oligonucleotides
acattatcttcattaaacaa

SEQ ID NO: 142 - DNA, 20 bp, Artificial
  Antisense Oligonucleotides
ataactctgtgtattagcat

SEQ ID NO: 143 - DNA, 19 bp, Artificial
  Antisense Oligonucleotides
cagattttatttgtcattc

SEQ ID NO: 144 - DNA, 19 bp, Artificial
  Antisense Oligonucleotides
agaaaagaatgaaactgtt

SEQ ID NO: 145 - DNA, 18 bp, Artificial
  Antisense Oligonucleotides
tgaattaaaatgagagta

SEQ ID NO: 146 - DNA, 18 bp, Artificial
  Antisense Oligonucleotides
taacttttcagatggcat

SEQ ID NO: 147 - DNA, 18 bp, Artificial
  Antisense Oligonucleotides
taagtcatcatcatcgtc

SEQ ID NO: 148 - DNA, 20 bp, Artificial
  Antisense Oligonucleotides
aaagaacagtcctaatacaa

SEQ ID NO: 149 - DNA, 17 bp, Artificial
  Antisense Oligonucleotides
ccaaagaacagtcctaa

SEQ ID NO: 150 - DNA, 20 bp, Artificial
  Antisense Oligonucleotides
ataagtaacaacacagatga

SEQ ID NO: 151 - DNA, 19 bp, Artificial
  Antisense Oligonucleotides
caataagtaacaacacaga

SEQ ID NO: 152 - DNA, 20 bp, Artificial
  Antisense Oligonucleotides
gcaaaagtcttaaatacttc

SEQ ID NO: 153 - DNA, 18 bp, Artificial
  Antisense Oligonucleotides
gcaaaagtcttaaatact

SEQ ID NO: 154 - DNA, 19 bp, Artificial
  Antisense Oligonucleotides
atcaatattaaatatttct

SEQ ID NO: 155 - DNA, 17 bp, Artificial
  Antisense Oligonucleotides
atcaggacaggttattt

SEQ ID NO: 156 - DNA, 20 bp, Artificial
  Antisense Oligonucleotides
tatattactagtcaaagggc

SEQ ID NO: 157 - DNA, 17 bp, Artificial
  Antisense Oligonucleotides
cttattaggtaattgaa

SEQ ID NO: 158 - DNA, 20 bp, Artificial
  Antisense Oligonucleotides
tacatattatattactcctc

SEQ ID NO: 159 - DNA, 18 bp, Artificial
  Antisense Oligonucleotides
atttaagtttattgagat

SEQ ID NO: 160 - DNA, 17 bp, Artificial
  Antisense Oligonucleotides
aatagtttcaagtccag

SEQ ID NO: 161 - DNA, 20 bp, Artificial
  Antisense Oligonucleotides
atttagcacatacatttaac

SEQ ID NO: 162 - DNA, 19 bp, Artificial
  Antisense Oligonucleotides
cctttggttatttgtttat

SEQ ID NO: 163 - DNA, 18 bp, Artificial
  Antisense Oligonucleotides
gttaattatttgttattg

SEQ ID NO: 164 - DNA, 20 bp, Artificial
  Antisense Oligonucleotides
ataaattttattaattgcct

SEQ ID NO: 165 - DNA, 19 bp, Artificial
  Antisense Oligonucleotides
tttacaggattgttatcaa

SEQ ID NO: 166 - DNA, 17 bp, Artificial
  Antisense Oligonucleotides
ctaaatttacaggattg

SEQ ID NO: 167 - DNA, 19 bp, Artificial
  Antisense Oligonucleotides
ttttgaggattaaagagaa

SEQ ID NO: 168 - DNA, 20 bp, Artificial
  Antisense Oligonucleotides
ttgttttgaggattaaagag

SEQ ID NO: 169 - DNA, 20 bp, Artificial
  Antisense Oligonucleotides
attgcttaaattgacctcta

SEQ ID NO: 170 - DNA, 19 bp, Artificial
  Antisense Oligonucleotides
attaaattgcttaaattga

SEQ ID NO: 171 - DNA, 20 bp, Artificial
  Antisense Oligonucleotides
tttattttaagctgaagaca

SEQ ID NO: 172 - DNA, 17 bp, Artificial
  Antisense Oligonucleotides
tggttggtataaatttt

SEQ ID NO: 173 - DNA, 20 bp, Artificial
  Antisense Oligonucleotides
gtgatattcaagaaatagca

SEQ ID NO: 174 - DNA, 17 bp, Artificial
  Antisense Oligonucleotides
tgttaagatgtaattgg

SEQ ID NO: 175 - DNA, 20 bp, Artificial
  Antisense Oligonucleotides
aacatattaagtacaagtga

SEQ ID NO: 176 - DNA, 18 bp, Artificial
  Antisense Oligonucleotides
acatattaagtacaagtg

SEQ ID NO: 177 - DNA, 18 bp, Artificial
  Antisense Oligonucleotides
acaaatcattagtctatt

SEQ ID NO: 178 - DNA, 17 bp, Artificial
  Antisense Oligonucleotides
cacaaatcattagtcta

SEQ ID NO: 179 - DNA, 20 bp, Artificial
  Antisense Oligonucleotides
catattatgctgttttcctg

SEQ ID NO: 180 - DNA, 18 bp, Artificial
  Antisense Oligonucleotides
ttcatattatgctgtttt

SEQ ID NO: 181 - DNA, 18 bp, Artificial
  Antisense Oligonucleotides
cagtgaaaatctaaatta

SEQ ID NO: 182 - DNA, 18 bp, Artificial
  Antisense Oligonucleotides
aatttgggaaggtttaga

SEQ ID NO: 183 - DNA, 18 bp, Artificial
  Antisense Oligonucleotides
gcaatttgggaaggttta

SEQ ID NO: 184 - DNA, 19 bp, Artificial
  Antisense Oligonucleotides
aggagaagacttaaatttt

SEQ ID NO: 185 - DNA, 18 bp, Artificial
  Antisense Oligonucleotides
gtggagagagttgaattt

SEQ ID NO: 186 - DNA, 17 bp, Artificial
  Antisense Oligonucleotides
aaagtgagtgttaaggt

SEQ ID NO: 187 - DNA, 18 bp, Artificial
  Antisense Oligonucleotides
attttaatttgtgagtag

SEQ ID NO: 188 - DNA, 20 bp, Artificial
  Antisense Oligonucleotides
aaattgaacaagtgaatagt

SEQ ID NO: 189 - DNA, 17 bp, Artificial
  Antisense Oligonucleotides
agtgaacttagtgatat

SEQ ID NO: 190 - DNA, 19 bp, Artificial
  Antisense Oligonucleotides
tgtttctaggtttcatttt

SEQ ID NO: 191 - DNA, 20 bp, Artificial
  Antisense Oligonucleotides
tactttacattcttttatgt

SEQ ID NO: 192 - DNA, 20 bp, Artificial
  Antisense Oligonucleotides
tcttctcaattactttacat

SEQ ID NO: 193 - DNA, 19 bp, Artificial
  Antisense Oligonucleotides
ctagtcatttctttgggtc

SEQ ID NO: 194 - DNA, 17 bp, Artificial
  Antisense Oligonucleotides
ctagtcatttctttggg

SEQ ID NO: 195 - DNA, 19 bp, Artificial
  Antisense Oligonucleotides
taatttatcatgtattcag

SEQ ID NO: 196 - DNA, 17 bp, Artificial
  Antisense Oligonucleotides
cattaccactatatcat

SEQ ID NO: 197 - DNA, 18 bp, Artificial
  Antisense Oligonucleotides
ttttcttatcaatatgca

SEQ ID NO: 198 - DNA, 18 bp, Artificial
  Antisense Oligonucleotides
tgaataatgttttactaa

SEQ ID NO: 199 - DNA, 18 bp, Artificial
  Antisense Oligonucleotides
atctgtgaatactttgaa

SEQ ID NO: 200 - DNA, 18 bp, Artificial
  Antisense Oligonucleotides
gaaatctgtgaatacttt

SEQ ID NO: 201 - DNA, 20 bp, Artificial
  Antisense Oligonucleotides
tatacttgttctctcacttt

SEQ ID NO: 202 - DNA, 18 bp, Artificial
  Antisense Oligonucleotides
cattaaatatacttgttc

SEQ ID NO: 203 - DNA, 19 bp, Artificial
  Antisense Oligonucleotides
atgaaaataaatgatctag

SEQ ID NO: 204 - DNA, 19 bp, Artificial
  Antisense Oligonucleotides
tcattcttaaaatactaac

SEQ ID NO: 205 - DNA, 19 bp, Artificial
  Antisense Oligonucleotides
cttgttttaaattctaata

SEQ ID NO: 206 - DNA, 19 bp, Artificial
  Antisense Oligonucleotides
tgatatagcaaagcaatgt

SEQ ID NO: 207 - DNA, 19 bp, Artificial
  Antisense Oligonucleotides
ttatgactggaagaacaaa

SEQ ID NO: 208 - DNA, 19 bp, Artificial
  Antisense Oligonucleotides
tgtttattatgactggaag

SEQ ID NO: 209 - DNA, 19 bp, Artificial
  Antisense Oligonucleotides
attttgacaagacttacat

SEQ ID NO: 210 - DNA, 18 bp, Artificial
  Antisense Oligonucleotides
tgcacttttatctttaac

SEQ ID NO: 211 - DNA, 19 bp, Artificial
  Antisense Oligonucleotides
atgatttaaatattttggg

SEQ ID NO: 212 - DNA, 20 bp, Artificial
  Antisense Oligonucleotides
tgaaattttaaggacagaaa

SEQ ID NO: 213 - DNA, 19 bp, Artificial
  Antisense Oligonucleotides
tttaatggaactaaactat

SEQ ID NO: 214 - DNA, 18 bp, Artificial
  Antisense Oligonucleotides
aaatgaacgaggaactgg

SEQ ID NO: 215 - DNA, 17 bp, Artificial
  Antisense Oligonucleotides
tgttactagtcatcatg

SEQ ID NO: 216 - DNA, 20 bp, Artificial
  Antisense Oligonucleotides
aggaaaattgtggaatcttt

SEQ ID NO: 217 - DNA, 17 bp, Artificial
  Antisense Oligonucleotides
atttgggttactaagga

SEQ ID NO: 218 - DNA, 19 bp, Artificial
  Antisense Oligonucleotides
aatagaaaattagtttaga

SEQ ID NO: 219 - DNA, 19 bp, Artificial
  Antisense Oligonucleotides
ttgcaaaataatatgttct

SEQ ID NO: 220 - DNA, 17 bp, Artificial
  Antisense Oligonucleotides
taaaggatggtatggct

SEQ ID NO: 221 - DNA, 17 bp, Artificial
  Antisense Oligonucleotides
tggagtaacaaaatgag

SEQ ID NO: 222 - DNA, 20 bp, Artificial
  Antisense Oligonucleotides
gttaagaaattttgaagtgc

SEQ ID NO: 223 - DNA, 18 bp, Artificial
  Antisense Oligonucleotides
agatcaaggctaaagaga

SEQ ID NO: 224 - DNA, 19 bp, Artificial
  Antisense Oligonucleotides
ttgatagtgaatgaaattt

SEQ ID NO: 225 - DNA, 18 bp, Artificial
  Antisense Oligonucleotides
taaaaagtggtagattcc

SEQ ID NO: 226 - DNA, 19 bp, Artificial
  Antisense Oligonucleotides
ttaaaaagtggtagattcc

SEQ ID NO: 227 - DNA, 18 bp, Artificial
  Antisense Oligonucleotides
tatatttaatcagatatc

SEQ ID NO: 228 - DNA, 18 bp, Artificial
  Antisense Oligonucleotides
tgcctgaataaagtaaga

SEQ ID NO: 229 - DNA, 19 bp, Artificial
  Antisense Oligonucleotides
taatttacttgacattttc

SEQ ID NO: 230 - DNA, 18 bp, Artificial
  Antisense Oligonucleotides
attattataagctatttg

SEQ ID NO: 231 - DNA, 18 bp, Artificial
  Antisense Oligonucleotides
taattgatataaagtagc

SEQ ID NO: 232 - DNA, 18 bp, Artificial
  Antisense Oligonucleotides
aagaacttcttcaatgca

SEQ ID NO: 233 - DNA, 17 bp, Artificial
  Antisense Oligonucleotides
aaaataggttaggtctg

SEQ ID NO: 234 - DNA, 17 bp, Artificial
  Antisense Oligonucleotides
gttgagaatacagattg

SEQ ID NO: 235 - DNA, 19 bp, Artificial
  Antisense Oligonucleotides
agacacatttcattttaag

SEQ ID NO: 236 - DNA, 20 bp, Artificial
  Antisense Oligonucleotides
tttatttacaatcctttaaa

SEQ ID NO: 237 - DNA, 19 bp, Artificial
  Antisense Oligonucleotides
tttatattaaggaccagac

SEQ ID NO: 238 - DNA, 18 bp, Artificial
  Antisense Oligonucleotides
ttttatattaaggaccag

SEQ ID NO: 239 - DNA, 19 bp, Artificial
  Antisense Oligonucleotides
tgtctataatatctccatc

SEQ ID NO: 240 - DNA, 19 bp, Artificial
  Antisense Oligonucleotides
cattatgatataaacatgt

SEQ ID NO: 241 - DNA, 20 bp, Artificial
  Antisense Oligonucleotides
taatctaaggtttactaaga

SEQ ID NO: 242 - DNA, 17 bp, Artificial
  Antisense Oligonucleotides
atggctactttggtttt

SEQ ID NO: 243 - DNA, 18 bp, Artificial
  Antisense Oligonucleotides
attgcctagaagaaatga

SEQ ID NO: 244 - DNA, 17 bp, Artificial
  Antisense Oligonucleotides
tttgtgataggtatatg

SEQ ID NO: 245 - DNA, 18 bp, Artificial
  Antisense Oligonucleotides
gtttctgtgataatttaa

SEQ ID NO: 246 - DNA, 19 bp, Artificial
  Antisense Oligonucleotides
tataaatggcagtacagat

SEQ ID NO: 247 - DNA, 19 bp, Artificial
  Antisense Oligonucleotides
atttataaatggcagtaca

SEQ ID NO: 248 - DNA, 20 bp, Artificial
  Antisense Oligonucleotides
tattttcttctttctgtact

SEQ ID NO: 249 - DNA, 20 bp, Artificial
  Antisense Oligonucleotides
agggaaggcaaaatctacat

SEQ ID NO: 250 - DNA, 18 bp, Artificial
  Antisense Oligonucleotides
acagagaaggtaatgcat

SEQ ID NO: 251 - DNA, 20 bp, Artificial
  Antisense Oligonucleotides
taagtgtatttgtaggggcc

SEQ ID NO: 252 - DNA, 20 bp, Artificial
  Antisense Oligonucleotides
gctattaggtaagtgtattt

SEQ ID NO: 253 - DNA, 19 bp, Artificial
  Antisense Oligonucleotides
cctttacctcattcaaaac

SEQ ID NO: 254 - DNA, 17 bp, Artificial
  Antisense Oligonucleotides
cctttacctcattcaaa

SEQ ID NO: 255 - DNA, 20 bp, Artificial
  Antisense Oligonucleotides
aagagtaagtaaaataaaga

SEQ ID NO: 256 - DNA, 17 bp, Artificial
  Antisense Oligonucleotides
cttggaatttgtgggat

SEQ ID NO: 257 - DNA, 18 bp, Artificial
  Antisense Oligonucleotides
gtttatagattgattcat

SEQ ID NO: 258 - DNA, 19 bp, Artificial
  Antisense Oligonucleotides
agtaatttataagaacatt

SEQ ID NO: 259 - DNA, 19 bp, Artificial
  Antisense Oligonucleotides
caatgtgtttatgttttga

SEQ ID NO: 260 - DNA, 20 bp, Artificial
  Antisense Oligonucleotides
tttctaattttcatgtctat

SEQ ID NO: 261 - DNA, 18 bp, Artificial
  Antisense Oligonucleotides
attgtttctcatattccc

SEQ ID NO: 262 - DNA, 18 bp, Artificial
  Antisense Oligonucleotides
aaacatcaagtaaaggca

SEQ ID NO: 263 - DNA, 17 bp, Artificial
  Antisense Oligonucleotides
attctgagtaaggggtc

SEQ ID NO: 264 - DNA, 19 bp, Artificial
  Antisense Oligonucleotides
atacattttacattattct

SEQ ID NO: 265 - DNA, 20 bp, Artificial
  Antisense Oligonucleotides
atattcatacatacatattc

SEQ ID NO: 266 - DNA, 18 bp, Artificial
  Antisense Oligonucleotides
ctacattaaaatatggcc

SEQ ID NO: 267 - DNA, 18 bp, Artificial
  Antisense Oligonucleotides
ttcataaattccaggtgc

SEQ ID NO: 268 - DNA, 19 bp, Artificial
  Antisense Oligonucleotides
tagcaatacatgagaagaa

SEQ ID NO: 269 - DNA, 18 bp, Artificial
  Antisense Oligonucleotides
attctgtgttgtgcttta

SEQ ID NO: 270 - DNA, 18 bp, Artificial
  Antisense Oligonucleotides
gagtaaatgtttctgaat

SEQ ID NO: 271 - DNA, 18 bp, Artificial
  Antisense Oligonucleotides
tatatactttagattaca

SEQ ID NO: 272 - DNA, 20 bp, Artificial
  Antisense Oligonucleotides
ctgtatttattagtttccac

SEQ ID NO: 273 - DNA, 18 bp, Artificial
  Antisense Oligonucleotides
ttcttactaatgttgaac

SEQ ID NO: 274 - DNA, 20 bp, Artificial
  Antisense Oligonucleotides
attatacattttattattat

SEQ ID NO: 275 - DNA, 18 bp, Artificial
  Antisense Oligonucleotides
aggtgacataagagaacc

SEQ ID NO: 276 - DNA, 18 bp, Artificial
  Antisense Oligonucleotides
acattaagtttgaatacc

SEQ ID NO: 277 - DNA, 19 bp, Artificial
  Antisense Oligonucleotides
ttttctctggcttaaatat

SEQ ID NO: 278 - DNA, 20 bp, Artificial
  Antisense Oligonucleotides
attaatatacaaagaagatg

SEQ ID NO: 279 - DNA, 18 bp, Artificial
  Antisense Oligonucleotides
cagattaatatacaaaga

SEQ ID NO: 280 - DNA, 17 bp, Artificial
  Antisense Oligonucleotides
aagctttagtgggaggg

SEQ ID NO: 281 - DNA, 17 bp, Artificial
  Antisense Oligonucleotides
acaaagggtagtaatat

SEQ ID NO: 282 - DNA, 18 bp, Artificial
  Antisense Oligonucleotides
cttacatgtcattttctg

SEQ ID NO: 283 - DNA, 20 bp, Artificial
  Antisense Oligonucleotides
tcttatttacaatacaggta

SEQ ID NO: 284 - DNA, 18 bp, Artificial
  Antisense Oligonucleotides
tcaaacatttctttagga

SEQ ID NO: 285 - DNA, 20 bp, Artificial
  Antisense Oligonucleotides
taataattcaaacatttctt

SEQ ID NO: 286 - DNA, 19 bp, Artificial
  Antisense Oligonucleotides
gaataatgaataaatgcca

SEQ ID NO: 287 - DNA, 18 bp, Artificial
  Antisense Oligonucleotides
agagaatgaaagtctaca

SEQ ID NO: 288 - DNA, 19 bp, Artificial
  Antisense Oligonucleotides
cagagaatgaaagtctaca

SEQ ID NO: 289 - DNA, 20 bp, Artificial
  Antisense Oligonucleotides
ccagagaatgaaagtctaca

SEQ ID NO: 290 - DNA, 18 bp, Artificial
  Antisense Oligonucleotides
cagagaatgaaagtctac

SEQ ID NO: 291 - DNA, 19 bp, Artificial
  Antisense Oligonucleotides
ccagagaatgaaagtctac

SEQ ID NO: 292 - DNA, 20 bp, Artificial
  Antisense Oligonucleotides
accagagaatgaaagtctac

SEQ ID NO: 293 - DNA, 18 bp, Artificial
  Antisense Oligonucleotides
ccagagaatgaaagtcta

SEQ ID NO: 294 - DNA, 19 bp, Artificial
  Antisense Oligonucleotides
accagagaatgaaagtcta

SEQ ID NO: 295 - DNA, 20 bp, Artificial
  Antisense Oligonucleotides
aaccagagaatgaaagtcta

SEQ ID NO: 296 - DNA, 18 bp, Artificial
  Antisense Oligonucleotides
accagagaatgaaagtct

SEQ ID NO: 297 - DNA, 19 bp, Artificial
  Antisense Oligonucleotides
aaccagagaatgaaagtct

SEQ ID NO: 298 - DNA, 17 bp, Artificial
  Antisense Oligonucleotides
accagagaatgaaagtc

SEQ ID NO: 299 - DNA, 18 bp, Artificial
  Antisense Oligonucleotides
aaccagagaatgaaagtc

SEQ ID NO: 300 - DNA, 19 bp, Artificial
  Antisense Oligonucleotides
gaaccagagaatgaaagtc

SEQ ID NO: 301 - DNA, 18 bp, Artificial
  Antisense Oligonucleotides
gaaccagagaatgaaagt

SEQ ID NO: 302 - DNA, 20 bp, Artificial
  Antisense Oligonucleotides
atggaaccagagaatgaaag

SEQ ID NO: 303 - DNA, 19 bp, Artificial
  Antisense Oligonucleotides
atggaaccagagaatgaaa

SEQ ID NO: 304 - DNA, 17 bp, Artificial
  Antisense Oligonucleotides
tattgtggagtatggaa

SEQ ID NO: 305 - DNA, 18 bp, Artificial
  Antisense Oligonucleotides
gaaaggtaataaattagg

SEQ ID NO: 306 - DNA, 19 bp, Artificial
  Antisense Oligonucleotides
tggaaggtaaatgactgaa

SEQ ID NO: 307 - DNA, 20 bp, Artificial
  Antisense Oligonucleotides
atgaaaattgtatctgtaaa

SEQ ID NO: 308 - DNA, 18 bp, Artificial
  Antisense Oligonucleotides
aagctaatgaaaattgta

SEQ ID NO: 309 - DNA, 20 bp, Artificial
  Antisense Oligonucleotides
aaggaatagcatgattaaca

SEQ ID NO: 310 - DNA, 17 bp, Artificial
  Antisense Oligonucleotides
tggctgagaggtgaatc

SEQ ID NO: 311 - DNA, 18 bp, Artificial
  Antisense Oligonucleotides
tctaaattaaagtgaaga

SEQ ID NO: 312 - DNA, 20 bp, Artificial
  Antisense Oligonucleotides
tgaagtcaaaattagtcatc

SEQ ID NO: 313 - DNA, 18 bp, Artificial
  Antisense Oligonucleotides
tgaagtcaaaattagtca

SEQ ID NO: 314 - DNA, 18 bp, Artificial
  Antisense Oligonucleotides
atttacttcagtaccatt

SEQ ID NO: 315 - DNA, 17 bp, Artificial
  Antisense Oligonucleotides
gctgctttgatagatga

SEQ ID NO: 316 - DNA, 18 bp, Artificial
  Antisense Oligonucleotides
gtgctggggtcttaactt

SEQ ID NO: 317 - DNA, 17 bp, Artificial
  Antisense Oligonucleotides
tatttaagttcttgtca

SEQ ID NO: 318 - DNA, 20 bp, Artificial
  Antisense Oligonucleotides
acttcatagtaggtgtcaga

SEQ ID NO: 319 - DNA, 20 bp, Artificial
  Antisense Oligonucleotides
ttaattcttccctagatgtc

SEQ ID NO: 320 - DNA, 20 bp, Artificial
  Antisense Oligonucleotides
aaggttgttaatgctaaaga

SEQ ID NO: 321 - DNA, 18 bp, Artificial
  Antisense Oligonucleotides
taatactttatgtaatag

SEQ ID NO: 322 - DNA, 17 bp, Artificial
  Antisense Oligonucleotides
attcttaaaggtctaag

SEQ ID NO: 323 - DNA, 19 bp, Artificial
  Antisense Oligonucleotides
tagttgacacatattataa

SEQ ID NO: 324 - DNA, 17 bp, Artificial
  Antisense Oligonucleotides
gtgattttatagttggt

SEQ ID NO: 325 - DNA, 19 bp, Artificial
  Antisense Oligonucleotides
gaatattttataatttgat

SEQ ID NO: 326 - DNA, 18 bp, Artificial
  Antisense Oligonucleotides
tacatataaatctaaagg

SEQ ID NO: 327 - DNA, 20 bp, Artificial
  Antisense Oligonucleotides
tttgtttcaccattttatac

SEQ ID NO: 328 - DNA, 19 bp, Artificial
  Antisense Oligonucleotides
tttgtttcaccattttata

SEQ ID NO: 329 - DNA, 20 bp, Artificial
  Antisense Oligonucleotides
ctatgtcaatttaattctta

SEQ ID NO: 330 - DNA, 20 bp, Artificial
  Antisense Oligonucleotides
ttatttactttgctccacac

SEQ ID NO: 331 - DNA, 18 bp, Artificial
  Antisense Oligonucleotides
ctttatttactttgctcc

SEQ ID NO: 332 - DNA, 19 bp, Artificial
  Antisense Oligonucleotides
agtcagagaggtaaaattc

SEQ ID NO: 333 - DNA, 18 bp, Artificial
  Antisense Oligonucleotides
gaatgataaaagtttaca

SEQ ID NO: 334 - DNA, 20 bp, Artificial
  Antisense Oligonucleotides
atggagaatgataaaagttt

SEQ ID NO: 335 - DNA, 18 bp, Artificial
  Antisense Oligonucleotides
tggagaatgataaaagtt

SEQ ID NO: 336 - DNA, 17 bp, Artificial
  Antisense Oligonucleotides
ctagatggttagaattc

SEQ ID NO: 337 - DNA, 20 bp, Artificial
  Antisense Oligonucleotides
atatattttaattctattaa

SEQ ID NO: 338 - DNA, 17 bp, Artificial
  Antisense Oligonucleotides
tagctgttttggaagat

SEQ ID NO: 339 - DNA, 17 bp, Artificial
  Antisense Oligonucleotides
agtttgagatactatgt

SEQ ID NO: 340 - DNA, 18 bp, Artificial
  Antisense Oligonucleotides
ttcacttttgagtttaat

SEQ ID NO: 341 - DNA, 18 bp, Artificial
  Antisense Oligonucleotides
tagtttaggtttaataaa

SEQ ID NO: 342 - DNA, 19 bp, Artificial
  Antisense Oligonucleotides
atttagaagaataaaggga

SEQ ID NO: 343 - DNA, 17 bp, Artificial
  Antisense Oligonucleotides
cacttacttcagggatt

SEQ ID NO: 344 - DNA, 17 bp, Artificial
  Antisense Oligonucleotides
cttagatgtaattttgc

SEQ ID NO: 345 - DNA, 18 bp, Artificial
  Antisense Oligonucleotides
aatttgtctatatcttta

SEQ ID NO: 346 - DNA, 17 bp, Artificial
  Antisense Oligonucleotides
tataaggatattagttg

SEQ ID NO: 347 - DNA, 18 bp, Artificial
  Antisense Oligonucleotides
tggtggactgtagatttc

SEQ ID NO: 348 - DNA, 18 bp, Artificial
  Antisense Oligonucleotides
gtttatttaatgtctgat

SEQ ID NO: 349 - DNA, 18 bp, Artificial
  Antisense Oligonucleotides
gctgctgtataatatatt

SEQ ID NO: 350 - DNA, 19 bp, Artificial
  Antisense Oligonucleotides
aattgtttaagagggagct

SEQ ID NO: 351 - DNA, 17 bp, Artificial
  Antisense Oligonucleotides
ttatttgtctgagtgta

SEQ ID NO: 352 - DNA, 20 bp, Artificial
  Antisense Oligonucleotides
acacactgtaagagacaagc

SEQ ID NO: 353 - DNA, 18 bp, Artificial
  Antisense Oligonucleotides
acacactgtaagagacaa

SEQ ID NO: 354 - DNA, 19 bp, Artificial
  Antisense Oligonucleotides
ttaagtaggtcacatttaa

SEQ ID NO: 355 - DNA, 18 bp, Artificial
  Antisense Oligonucleotides
atttaagtaggtcacatt

SEQ ID NO: 356 - DNA, 20 bp, Artificial
  Antisense Oligonucleotides
attagcattaattattactc

SEQ ID NO: 357 - DNA, 20 bp, Artificial
  Antisense Oligonucleotides
ctcattattagcattaatta

SEQ ID NO: 358 - DNA, 18 bp, Artificial
  Antisense Oligonucleotides
atgaggtggaaaatgtga

SEQ ID NO: 359 - DNA, 20 bp, Artificial
  Antisense Oligonucleotides
ttatcatttaatatttatta

SEQ ID NO: 360 - DNA, 20 bp, Artificial
  Antisense Oligonucleotides
gtgaggagtgattaaatacc

SEQ ID NO: 361 - DNA, 20 bp, Artificial
  Antisense Oligonucleotides
gactttataacaatagtact

SEQ ID NO: 362 - DNA, 20 bp, Artificial
  Antisense Oligonucleotides
gcatcttagaatttgtctgc

SEQ ID NO: 363 - DNA, 19 bp, Artificial
  Antisense Oligonucleotides
gcatcttagaatttgtctg

SEQ ID NO: 364 - DNA, 17 bp, Artificial
  Antisense Oligonucleotides
aggattattagggcatc

SEQ ID NO: 365 - DNA, 20 bp, Artificial
  Antisense Oligonucleotides
atgtttaaagaggtgactga

SEQ ID NO: 366 - DNA, 17 bp, Artificial
  Antisense Oligonucleotides
gttatggagacagggat

SEQ ID NO: 367 - DNA, 18 bp, Artificial
  Antisense Oligonucleotides
gaattttgttatggagac

SEQ ID NO: 368 - DNA, 20 bp, Artificial
  Antisense Oligonucleotides
agtgtcttaataaatcagcc

SEQ ID NO: 369 - DNA, 18 bp, Artificial
  Antisense Oligonucleotides
tttggaaatagttttgac

SEQ ID NO: 370 - DNA, 19 bp, Artificial
  Antisense Oligonucleotides
aatattcttctttgatttt

SEQ ID NO: 371 - DNA, 19 bp, Artificial
  Antisense Oligonucleotides
ttaatattcttctttgatt

SEQ ID NO: 372 - DNA, 17 bp, Artificial
  Antisense Oligonucleotides
tagttcaacaatctaat

SEQ ID NO: 373 - DNA, 19 bp, Artificial
  Antisense Oligonucleotides
tttctagtttctgatgatc

SEQ ID NO: 374 - DNA, 20 bp, Artificial
  Antisense Oligonucleotides
ctttctagtttctgatgatc

SEQ ID NO: 375 - DNA, 18 bp, Artificial
  Antisense Oligonucleotides
tttctagtttctgatgat

SEQ ID NO: 376 - DNA, 19 bp, Artificial
  Antisense Oligonucleotides
ctttctagtttctgatgat

SEQ ID NO: 377 - DNA, 20 bp, Artificial
  Antisense Oligonucleotides
tctttctagtttctgatgat

SEQ ID NO: 378 - DNA, 17 bp, Artificial
  Antisense Oligonucleotides
gttctcaccaatattag

SEQ ID NO: 379 - DNA, 19 bp, Artificial
  Antisense Oligonucleotides
aaagttataaatattctag

SEQ ID NO: 380 - DNA, 19 bp, Artificial
  Antisense Oligonucleotides
tatttattctttaaattac

SEQ ID NO: 381 - DNA, 17 bp, Artificial
  Antisense Oligonucleotides
tgagaccttatattatt

SEQ ID NO: 382 - DNA, 18 bp, Artificial
  Antisense Oligonucleotides
gtttcttatattcatcac

SEQ ID NO: 383 - DNA, 19 bp, Artificial
  Antisense Oligonucleotides
aacaataaaattgagggag

SEQ ID NO: 384 - DNA, 20 bp, Artificial
  Antisense Oligonucleotides
gaatgatataggtgaatttg

SEQ ID NO: 385 - DNA, 17 bp, Artificial
  Antisense Oligonucleotides
aatgtaacttgttgagt

SEQ ID NO: 386 - DNA, 18 bp, Artificial
  Antisense Oligonucleotides
aaatgtaacttgttgagt

SEQ ID NO: 387 - DNA, 19 bp, Artificial
  Antisense Oligonucleotides
gaaatgtaacttgttgagt

SEQ ID NO: 388 - DNA, 20 bp, Artificial
  Antisense Oligonucleotides
agaaatgtaacttgttgagt

SEQ ID NO: 389 - DNA, 17 bp, Artificial
  Antisense Oligonucleotides
aaatgtaacttgttgag

SEQ ID NO: 390 - DNA, 18 bp, Artificial
  Antisense Oligonucleotides
gaaatgtaacttgttgag

SEQ ID NO: 391 - DNA, 19 bp, Artificial
  Antisense Oligonucleotides
agaaatgtaacttgttgag

SEQ ID NO: 392 - DNA, 20 bp, Artificial
  Antisense Oligonucleotides
tagaaatgtaacttgttgag

SEQ ID NO: 393 - DNA, 18 bp, Artificial
  Antisense Oligonucleotides
agaaatgtaacttgttga

SEQ ID NO: 394 - DNA, 19 bp, Artificial
  Antisense Oligonucleotides
tagaaatgtaacttgttga

SEQ ID NO: 395 - DNA, 20 bp, Artificial
  Antisense Oligonucleotides
ctagaaatgtaacttgttga

SEQ ID NO: 396 - DNA, 18 bp, Artificial
  Antisense Oligonucleotides
tagaaatgtaacttgttg

SEQ ID NO: 397 - DNA, 19 bp, Artificial
  Antisense Oligonucleotides
ctagaaatgtaacttgttg

SEQ ID NO: 398 - DNA, 20 bp, Artificial
  Antisense Oligonucleotides
cctagaaatgtaacttgttg

SEQ ID NO: 399 - DNA, 18 bp, Artificial
  Antisense Oligonucleotides
ctagaaatgtaacttgtt

SEQ ID NO: 400 - DNA, 19 bp, Artificial
  Antisense Oligonucleotides
cctagaaatgtaacttgtt

SEQ ID NO: 401 - DNA, 20 bp, Artificial
  Antisense Oligonucleotides
acctagaaatgtaacttgtt

SEQ ID NO: 402 - DNA, 18 bp, Artificial
  Antisense Oligonucleotides
cctagaaatgtaacttgt

SEQ ID NO: 403 - DNA, 19 bp, Artificial
  Antisense Oligonucleotides
acctagaaatgtaacttgt

SEQ ID NO: 404 - DNA, 20 bp, Artificial
  Antisense Oligonucleotides
cacctagaaatgtaacttgt

SEQ ID NO: 405 - DNA, 18 bp, Artificial
  Antisense Oligonucleotides
acctagaaatgtaacttg

SEQ ID NO: 406 - DNA, 19 bp, Artificial
  Antisense Oligonucleotides
cacctagaaatgtaacttg

SEQ ID NO: 407 - DNA, 20 bp, Artificial
  Antisense Oligonucleotides
acacctagaaatgtaacttg

SEQ ID NO: 408 - DNA, 18 bp, Artificial
  Antisense Oligonucleotides
cacctagaaatgtaactt

SEQ ID NO: 409 - DNA, 19 bp, Artificial
  Antisense Oligonucleotides
acacctagaaatgtaactt

SEQ ID NO: 410 - DNA, 17 bp, Artificial
  Antisense Oligonucleotides
cacctagaaatgtaact

SEQ ID NO: 411 - DNA, 18 bp, Artificial
  Antisense Oligonucleotides
acacctagaaatgtaact

SEQ ID NO: 412 - DNA, 18 bp, Artificial
  Antisense Oligonucleotides
ctatacacctagaaatgt

SEQ ID NO: 413 - DNA, 19 bp, Artificial
  Antisense Oligonucleotides
actatacacctagaaatgt

SEQ ID NO: 414 - DNA, 20 bp, Artificial
  Antisense Oligonucleotides
tactatacacctagaaatgt

SEQ ID NO: 415 - DNA, 19 bp, Artificial
  Antisense Oligonucleotides
tactatacacctagaaatg

SEQ ID NO: 416 - DNA, 18 bp, Artificial
  Antisense Oligonucleotides
tactatacacctagaaat

SEQ ID NO: 417 - DNA, 19 bp, Artificial
  Antisense Oligonucleotides
ctactatacacctagaaat

SEQ ID NO: 418 - DNA, 20 bp, Artificial
  Antisense Oligonucleotides
cctactatacacctagaaat

SEQ ID NO: 419 - DNA, 18 bp, Artificial
  Antisense Oligonucleotides
ctactatacacctagaaa

SEQ ID NO: 420 - DNA, 19 bp, Artificial
  Antisense Oligonucleotides
cctactatacacctagaaa

SEQ ID NO: 421 - DNA, 20 bp, Artificial
  Antisense Oligonucleotides
tcctactatacacctagaaa

SEQ ID NO: 422 - DNA, 20 bp, Artificial
  Antisense Oligonucleotides
ttcctactatacacctagaa

SEQ ID NO: 423 - DNA, 18 bp, Artificial
  Antisense Oligonucleotides
tcctactatacacctaga

SEQ ID NO: 424 - DNA, 18 bp, Artificial
  Antisense Oligonucleotides
ttcctactatacacctag

SEQ ID NO: 425 - DNA, 17 bp, Artificial
  Antisense Oligonucleotides
ttcctactatacaccta

SEQ ID NO: 426 - DNA, 17 bp, Artificial
  Antisense Oligonucleotides
tgttcctactatacacc

SEQ ID NO: 427 - DNA, 18 bp, Artificial
  Antisense Oligonucleotides
ttgttcctactatacacc

SEQ ID NO: 428 - DNA, 19 bp, Artificial
  Antisense Oligonucleotides
tttgttcctactatacacc

SEQ ID NO: 429 - DNA, 17 bp, Artificial
  Antisense Oligonucleotides
ttgttcctactatacac

SEQ ID NO: 430 - DNA, 18 bp, Artificial
  Antisense Oligonucleotides
tttgttcctactatacac

SEQ ID NO: 431 - DNA, 19 bp, Artificial
  Antisense Oligonucleotides
ttttgttcctactatacac

SEQ ID NO: 432 - DNA, 20 bp, Artificial
  Antisense Oligonucleotides
gttttgttcctactatacac

SEQ ID NO: 433 - DNA, 17 bp, Artificial
  Antisense Oligonucleotides
tttgttcctactataca

SEQ ID NO: 434 - DNA, 18 bp, Artificial
  Antisense Oligonucleotides
ttttgttcctactataca

SEQ ID NO: 435 - DNA, 19 bp, Artificial
  Antisense Oligonucleotides
gttttgttcctactataca

SEQ ID NO: 436 - DNA, 18 bp, Artificial
  Antisense Oligonucleotides
cagagttgttttgttctc

SEQ ID NO: 437 - DNA, 17 bp, Artificial
  Antisense Oligonucleotides
aggttatcagtgtgggc

SEQ ID NO: 438 - DNA, 20 bp, Artificial
  Antisense Oligonucleotides
aacaaataacaactttctgc

SEQ ID NO: 439 - DNA, 17 bp, Artificial
  Antisense Oligonucleotides
tttataagtttagtctg

SEQ ID NO: 440 - DNA, 20 bp, Artificial
  Antisense Oligonucleotides
atattggtctgttttgttcc

SEQ ID NO: 441 - DNA, 19 bp, Artificial
  Antisense Oligonucleotides
aaatcgttctttacatgaa

SEQ ID NO: 442 - DNA, 20 bp, Artificial
  Antisense Oligonucleotides
ttaaaatcgttctttacatg

SEQ ID NO: 443 - DNA, 18 bp, Artificial
  Antisense Oligonucleotides
tttaaaatcgttctttac

SEQ ID NO: 444 - DNA, 18 bp, Artificial
  Antisense Oligonucleotides
agttggtttaaaatgtgt

SEQ ID NO: 445 - DNA, 18 bp, Artificial
  Antisense Oligonucleotides
ttccaaattttccactaa

SEQ ID NO: 446 - DNA, 18 bp, Artificial
  Antisense Oligonucleotides
attattatggtgttttgt

SEQ ID NO: 447 - DNA, 19 bp, Artificial
  Antisense Oligonucleotides
gcatacataattatttgtc

SEQ ID NO: 448 - DNA, 20 bp, Artificial
  Antisense Oligonucleotides
ttgcatacataattatttgt

SEQ ID NO: 449 - DNA, 17 bp, Artificial
  Antisense Oligonucleotides
attcttagcttgtatgt

SEQ ID NO: 450 - DNA, 18 bp, Artificial
  Antisense Oligonucleotides
ttattctcaatcaacttt

SEQ ID NO: 451 - DNA, 17 bp, Artificial
  Antisense Oligonucleotides
ctttagtggacagaatg

SEQ ID NO: 452 - DNA, 18 bp, Artificial
  Antisense Oligonucleotides
tcatcattctgtctatgg

SEQ ID NO: 453 - DNA, 18 bp, Artificial
  Antisense Oligonucleotides
gttggattattattgtaa

SEQ ID NO: 454 - DNA, 17 bp, Artificial
  Antisense Oligonucleotides
gaccagaagatgtaatt

SEQ ID NO: 455 - DNA, 19 bp, Artificial
  Antisense Oligonucleotides
aagcagtttattttcttta

SEQ ID NO: 456 - DNA, 19 bp, Artificial
  Antisense Oligonucleotides
tagatttataaggattgta

SEQ ID NO: 457 - DNA, 17 bp, Artificial
  Antisense Oligonucleotides
tagatttataaggattg

SEQ ID NO: 458 - DNA, 20 bp, Artificial
  Antisense Oligonucleotides
aggtacaataataaacaaga

SEQ ID NO: 459 - DNA, 18 bp, Artificial
  Antisense Oligonucleotides
aggtacaataataaacaa

SEQ ID NO: 460 - DNA, 17 bp, Artificial
  Antisense Oligonucleotides
agatgttaaggaaggtc

SEQ ID NO: 461 - DNA, 19 bp, Artificial
  Antisense Oligonucleotides
aatccatgacatttattga

SEQ ID NO: 462 - DNA, 18 bp, Artificial
  Antisense Oligonucleotides
atgaagtttctgtggctg

SEQ ID NO: 463 - DNA, 18 bp, Artificial
  Antisense Oligonucleotides
tttatgaagtttctgtgg

SEQ ID NO: 464 - DNA, 16 bp, Artificial
  Antisense Oligonucleotides
gcattagggagttcag

SEQ ID NO: 465 - DNA, 17 bp, Artificial
  Antisense Oligonucleotides
cattagacctagaattg

SEQ ID NO: 466 - DNA, 18 bp, Artificial
  Antisense Oligonucleotides
aagtttaaaagtaagagc

SEQ ID NO: 467 - DNA, 18 bp, Artificial
  Antisense Oligonucleotides
gtcttatattacatcaaa

SEQ ID NO: 468 - DNA, 17 bp, Artificial
  Antisense Oligonucleotides
aattgagggacaggtag

SEQ ID NO: 469 - DNA, 20 bp, Artificial
  Antisense Oligonucleotides
aatctgccattttatcaagg

SEQ ID NO: 470 - DNA, 20 bp, Artificial
  Antisense Oligonucleotides
caagaatctgccattttatc

SEQ ID NO: 471 - DNA, 18 bp, Artificial
  Antisense Oligonucleotides
caagaatctgccatttta

SEQ ID NO: 472 - DNA, 17 bp, Artificial
  Antisense Oligonucleotides
ttactgggaatttagtt

SEQ ID NO: 473 - DNA, 20 bp, Artificial
  Antisense Oligonucleotides
acccttcataaactaagcaa

SEQ ID NO: 474 - DNA, 19 bp, Artificial
  Antisense Oligonucleotides
taactttcataatttggag

SEQ ID NO: 475 - DNA, 18 bp, Artificial
  Antisense Oligonucleotides
gaaaattacttacatagc

SEQ ID NO: 476 - DNA, 20 bp, Artificial
  Antisense Oligonucleotides
agaaaatacttatgttacaa

SEQ ID NO: 477 - DNA, 18 bp, Artificial
  Antisense Oligonucleotides
taagttggcaagggaagg

SEQ ID NO: 478 - DNA, 18 bp, Artificial
  Antisense Oligonucleotides
gaggattttgaggagagt

SEQ ID NO: 479 - DNA, 19 bp, Artificial
  Antisense Oligonucleotides
tagtaaattgtgaaagcag

SEQ ID NO: 480 - DNA, 17 bp, Artificial
  Antisense Oligonucleotides
tagtaaattgtgaaagc

SEQ ID NO: 481 - DNA, 18 bp, Artificial
  Antisense Oligonucleotides
aggtagaatgcagttgga

SEQ ID NO: 482 - DNA, 17 bp, Artificial
  Antisense Oligonucleotides
tttggagaatatgagcc

SEQ ID NO: 483 - DNA, 18 bp, Artificial
  Antisense Oligonucleotides
gtttggagaatatgagcc

SEQ ID NO: 484 - DNA, 19 bp, Artificial
  Antisense Oligonucleotides
gagagagaaaatttgagag

SEQ ID NO: 485 - DNA, 19 bp, Artificial
  Antisense Oligonucleotides
tttgttttggtttgggcac

SEQ ID NO: 486 - DNA, 19 bp, Artificial
  Antisense Oligonucleotides
cctgtggtttcatttgtat

SEQ ID NO: 487 - DNA, 19 bp, Artificial
  Antisense Oligonucleotides
aagatttgctaaatggatg

SEQ ID NO: 488 - DNA, 19 bp, Artificial
  Antisense Oligonucleotides
tttatttgtttattcacag

SEQ ID NO: 489 - DNA, 19 bp, Artificial
  Antisense Oligonucleotides
tcaaggtacaggcaaattt

SEQ ID NO: 490 - DNA, 19 bp, Artificial
  Antisense Oligonucleotides
tcctatccttaataatcta

SEQ ID NO: 491 - DNA, 19 bp, Artificial
  Antisense Oligonucleotides
ctgattttatattcccaac

SEQ ID NO: 492 - DNA, 18 bp, Artificial
  Antisense Oligonucleotides
ttggttttaatgggtaat

SEQ ID NO: 493 - DNA, 17 bp, Artificial
  Antisense Oligonucleotides
tgcttatgctttctagt

SEQ ID NO: 494 - DNA, 20 bp, Artificial
  Antisense Oligonucleotides
tacaatctgacctatgagaa

SEQ ID NO: 495 - DNA, 18 bp, Artificial
  Antisense Oligonucleotides
catctatttcttgggcat

SEQ ID NO: 496 - DNA, 18 bp, Artificial
  Antisense Oligonucleotides
aatttaatgaggagaggg

SEQ ID NO: 497 - DNA, 19 bp, Artificial
  Antisense Oligonucleotides
taggttctgacatatttat

SEQ ID NO: 498 - DNA, 18 bp, Artificial
  Antisense Oligonucleotides
gagaatgtctttacttgc

SEQ ID NO: 499 - DNA, 20 bp, Artificial
  Antisense Oligonucleotides
aagctgcattcatagagatc

SEQ ID NO: 500 - DNA, 20 bp, Artificial
  Antisense Oligonucleotides
attaatattttcaaaggaca

SEQ ID NO: 501 - DNA, 20 bp, Artificial
  Antisense Oligonucleotides
gtattaatattttcaaagga

SEQ ID NO: 502 - DNA, 19 bp, Artificial
  Antisense Oligonucleotides
tatattagaaaatttgcaa

SEQ ID NO: 503 - DNA, 18 bp, Artificial
  Antisense Oligonucleotides
tggtttcaaagtctatag

SEQ ID NO: 504 - DNA, 19 bp, Artificial
  Antisense Oligonucleotides
gtgtgtgtattatttgatt

SEQ ID NO: 505 - DNA, 17 bp, Artificial
  Antisense Oligonucleotides
gaaacagtattatgtag

SEQ ID NO: 506 - DNA, 18 bp, Artificial
  Antisense Oligonucleotides
ttgaaacagtattatgta

SEQ ID NO: 507 - DNA, 17 bp, Artificial
  Antisense Oligonucleotides
tagtgattttgtgagtt

SEQ ID NO: 508 - DNA, 17 bp, Artificial
  Antisense Oligonucleotides
ctagtgattttgtgagt

SEQ ID NO: 509 - DNA, 18 bp, Artificial
  Antisense Oligonucleotides
agaaaacaattacaatcc

SEQ ID NO: 510 - DNA, 20 bp, Artificial
  Antisense Oligonucleotides
tttctactttgttcattcat

SEQ ID NO: 511 - DNA, 20 bp, Artificial
  Antisense Oligonucleotides
ctaattcaaatcactatact

SEQ ID NO: 512 - DNA, 18 bp, Artificial
  Antisense Oligonucleotides
tggagatttaggatattg

SEQ ID NO: 513 - DNA, 19 bp, Artificial
  Antisense Oligonucleotides
gtggagatttaggatattg

SEQ ID NO: 514 - DNA, 20 bp, Artificial
  Antisense Oligonucleotides
agtggagatttaggatattg

SEQ ID NO: 515 - DNA, 19 bp, Artificial
  Antisense Oligonucleotides
agtggagatttaggatatt

SEQ ID NO: 516 - DNA, 20 bp, Artificial
  Antisense Oligonucleotides
cagtggagatttaggatatt

SEQ ID NO: 517 - DNA, 19 bp, Artificial
  Antisense Oligonucleotides
cagtggagatttaggatat

SEQ ID NO: 518 - DNA, 20 bp, Artificial
  Antisense Oligonucleotides
tcagtggagatttaggatat

SEQ ID NO: 519 - DNA, 18 bp, Artificial
  Antisense Oligonucleotides
cagtggagatttaggata

SEQ ID NO: 520 - DNA, 19 bp, Artificial
  Antisense Oligonucleotides
tcagtggagatttaggata

SEQ ID NO: 521 - DNA, 17 bp, Artificial
  Antisense Oligonucleotides
cagtggagatttaggat

SEQ ID NO: 522 - DNA, 18 bp, Artificial
  Antisense Oligonucleotides
tcagtggagatttaggat

SEQ ID NO: 523 - DNA, 18 bp, Artificial
  Antisense Oligonucleotides
tgtataattcacaatgtt

SEQ ID NO: 524 - DNA, 19 bp, Artificial
  Antisense Oligonucleotides
atgtataattcacaatgtt

SEQ ID NO: 525 - DNA, 20 bp, Artificial
  Antisense Oligonucleotides
gatgtataattcacaatgtt

SEQ ID NO: 526 - DNA, 19 bp, Artificial
  Antisense Oligonucleotides
gatgtataattcacaatgt

SEQ ID NO: 527 - DNA, 18 bp, Artificial
  Antisense Oligonucleotides
gatgtataattcacaatg

SEQ ID NO: 528 - DNA, 19 bp, Artificial
  Antisense Oligonucleotides
attaactgacaaaaggtaa

SEQ ID NO: 529 - DNA, 18 bp, Artificial
  Antisense Oligonucleotides
agaagctaaggtaataac

SEQ ID NO: 530 - DNA, 20 bp, Artificial
  Antisense Oligonucleotides
aataatgaggaagaaactgt

SEQ ID NO: 531 - DNA, 17 bp, Artificial
  Antisense Oligonucleotides
gtcttgtattatgtaat

SEQ ID NO: 532 - DNA, 19 bp, Artificial
  Antisense Oligonucleotides
agaaagtcttgtattatgt

SEQ ID NO: 533 - DNA, 18 bp, Artificial
  Antisense Oligonucleotides
aagaaagtcttgtattat

SEQ ID NO: 534 - DNA, 18 bp, Artificial
  Antisense Oligonucleotides
taattatatttatctgct

SEQ ID NO: 535 - DNA, 18 bp, Artificial
  Antisense Oligonucleotides
gatggtgaaaagggcatt

SEQ ID NO: 536 - DNA, 18 bp, Artificial
  Antisense Oligonucleotides
attttggacttcttaata

SEQ ID NO: 537 - DNA, 18 bp, Artificial
  Antisense Oligonucleotides
agaagggcaatttaattt

SEQ ID NO: 538 - DNA, 18 bp, Artificial
  Antisense Oligonucleotides
tatgtaacaggtaaagaa

SEQ ID NO: 539 - DNA, 20 bp, Artificial
  Antisense Oligonucleotides
gtaaatttaaggaaaatagg

SEQ ID NO: 540 - DNA, 20 bp, Artificial
  Antisense Oligonucleotides
agtaaatttaaggaaaatag

SEQ ID NO: 541 - DNA, 20 bp, Artificial
  Antisense Oligonucleotides
tatgttttaattagtaaata

SEQ ID NO: 542 - DNA, 20 bp, Artificial
  Antisense Oligonucleotides
aataagtaataatgactaca

SEQ ID NO: 543 - DNA, 19 bp, Artificial
  Antisense Oligonucleotides
tggattaagaaaactgatg

SEQ ID NO: 544 - DNA, 18 bp, Artificial
  Antisense Oligonucleotides
ttatttgctattgattag

SEQ ID NO: 545 - DNA, 20 bp, Artificial
  Antisense Oligonucleotides
ttttataccagtaaaccagg

SEQ ID NO: 546 - DNA, 17 bp, Artificial
  Antisense Oligonucleotides
ttttataccagtaaacc

SEQ ID NO: 547 - DNA, 19 bp, Artificial
  Antisense Oligonucleotides
gttttaactaaatgaacta

SEQ ID NO: 548 - DNA, 18 bp, Artificial
  Antisense Oligonucleotides
tctggattattggctttg

SEQ ID NO: 549 - DNA, 18 bp, Artificial
  Antisense Oligonucleotides
taattaagttttcttcct

SEQ ID NO: 550 - DNA, 18 bp, Artificial
  Antisense Oligonucleotides
cttgtgattttaagtgtt

SEQ ID NO: 551 - DNA, 20 bp, Artificial
  Antisense Oligonucleotides
tttaagaaccaaatttaaga

SEQ ID NO: 552 - DNA, 18 bp, Artificial
  Antisense Oligonucleotides
agttattcaaattgctta

SEQ ID NO: 553 - DNA, 17 bp, Artificial
  Antisense Oligonucleotides
aggaggtgttaactatg

SEQ ID NO: 554 - DNA, 19 bp, Artificial
  Antisense Oligonucleotides
taagattgctgaaagagag

SEQ ID NO: 555 - DNA, 17 bp, Artificial
  Antisense Oligonucleotides
agtagagggtaagattg

SEQ ID NO: 556 - DNA, 18 bp, Artificial
  Antisense Oligonucleotides
atttctgtgtttctaccc

SEQ ID NO: 557 - DNA, 18 bp, Artificial
  Antisense Oligonucleotides
aggaagttataatgaatg

SEQ ID NO: 558 - DNA, 20 bp, Artificial
  Antisense Oligonucleotides
tgtgagtttaaaatcctaat

SEQ ID NO: 559 - DNA, 17 bp, Artificial
  Antisense Oligonucleotides
tttgtaacttactacca

SEQ ID NO: 560 - DNA, 20 bp, Artificial
  Antisense Oligonucleotides
ttacatttctacattcctgg

SEQ ID NO: 561 - DNA, 18 bp, Artificial
  Antisense Oligonucleotides
attaaaggtaactattgc

SEQ ID NO: 562 - DNA, 16 bp, Artificial
  Antisense Oligonucleotides
gtctatcttactgtac

SEQ ID NO: 563 - DNA, 20 bp, Artificial
  Antisense Oligonucleotides
tatcatttgttttatgaatt

SEQ ID NO: 564 - DNA, 18 bp, Artificial
  Antisense Oligonucleotides
atagatttagtaatatct

SEQ ID NO: 565 - DNA, 17 bp, Artificial
  Antisense Oligonucleotides
agtgggagatatgatca

SEQ ID NO: 566 - DNA, 18 bp, Artificial
  Antisense Oligonucleotides
aaagaaagttactggatc

SEQ ID NO: 567 - DNA, 18 bp, Artificial
  Antisense Oligonucleotides
tgggagtttgattagctg

SEQ ID NO: 568 - DNA, 18 bp, Artificial
  Antisense Oligonucleotides
gaatagaaatatagacag

SEQ ID NO: 569 - DNA, 20 bp, Artificial
  Antisense Oligonucleotides
aaagcactgaaaactaagtt

SEQ ID NO: 570 - DNA, 17 bp, Artificial
  Antisense Oligonucleotides
gtagttggatttggttc

SEQ ID NO: 571 - DNA, 18 bp, Artificial
  Antisense Oligonucleotides
caaagattgaggtagttg

SEQ ID NO: 572 - DNA, 17 bp, Artificial
  Antisense Oligonucleotides
aatcattgtttgtcagc

SEQ ID NO: 573 - DNA, 19 bp, Artificial
  Antisense Oligonucleotides
gagtaggaaaattaaactc

SEQ ID NO: 574 - DNA, 18 bp, Artificial
  Antisense Oligonucleotides
gctataattttgagggta

SEQ ID NO: 575 - DNA, 18 bp, Artificial
  Antisense Oligonucleotides
tttgtcagggtaaaataa

SEQ ID NO: 576 - DNA, 19 bp, Artificial
  Antisense Oligonucleotides
ataatacattttggcagtc

SEQ ID NO: 577 - DNA, 19 bp, Artificial
  Antisense Oligonucleotides
aaacatttgagaaaacagg

SEQ ID NO: 578 - DNA, 19 bp, Artificial
  Antisense Oligonucleotides
ttccactctcttattttaa

SEQ ID NO: 579 - DNA, 18 bp, Artificial
  Antisense Oligonucleotides
tccattcacttattaata

SEQ ID NO: 580 - DNA, 18 bp, Artificial
  Antisense Oligonucleotides
aaagagtttggtttgatg

SEQ ID NO: 581 - DNA, 20 bp, Artificial
  Antisense Oligonucleotides
atattttataagtcttgcat

SEQ ID NO: 582 - DNA, 20 bp, Artificial
  Antisense Oligonucleotides
atattttatctttatttact

SEQ ID NO: 583 - DNA, 20 bp, Artificial
  Antisense Oligonucleotides
ctttatcatctaattccatc

SEQ ID NO: 584 - DNA, 18 bp, Artificial
  Antisense Oligonucleotides
tctgtgctttatcatcta

SEQ ID NO: 585 - DNA, 19 bp, Artificial
  Antisense Oligonucleotides
ttttagcttcaggtgtaca

SEQ ID NO: 586 - DNA, 19 bp, Artificial
  Antisense Oligonucleotides
attttagcttcaggtgtac

SEQ ID NO: 587 - DNA, 20 bp, Artificial
  Antisense Oligonucleotides
tggttgagattaaatgagat

SEQ ID NO: 588 - DNA, 20 bp, Artificial
  Antisense Oligonucleotides
attgtgttatacctattcca

SEQ ID NO: 589 - DNA, 18 bp, Artificial
  Antisense Oligonucleotides
aaaattgtgttataccta

SEQ ID NO: 590 - DNA, 19 bp, Artificial
  Antisense Oligonucleotides
tcgcactagaaaaaaataa

SEQ ID NO: 591 - DNA, 18 bp, Artificial
  Antisense Oligonucleotides
tcgcactagaaaaaaata

SEQ ID NO: 592 - DNA, 19 bp, Artificial
  Antisense Oligonucleotides
gtcgcactagaaaaaaata

SEQ ID NO: 593 - DNA, 20 bp, Artificial
  Antisense Oligonucleotides
agtcgcactagaaaaaaata

SEQ ID NO: 594 - DNA, 20 bp, Artificial
  Antisense Oligonucleotides
tgaagtcgcactagaaaaaa

SEQ ID NO: 595 - DNA, 19 bp, Artificial
  Antisense Oligonucleotides
tgaagtcgcactagaaaaa

SEQ ID NO: 596 - DNA, 20 bp, Artificial
  Antisense Oligonucleotides
atgaagtcgcactagaaaaa

SEQ ID NO: 597 - DNA, 18 bp, Artificial
  Antisense Oligonucleotides
tgaagtcgcactagaaaa

SEQ ID NO: 598 - DNA, 19 bp, Artificial
  Antisense Oligonucleotides
atgaagtcgcactagaaaa

SEQ ID NO: 599 - DNA, 20 bp, Artificial
  Antisense Oligonucleotides
catgaagtcgcactagaaaa

SEQ ID NO: 600 - DNA, 16 bp, Artificial
  Antisense Oligonucleotides
gaagtcgcactagaaa

SEQ ID NO: 601 - DNA, 17 bp, Artificial
  Antisense Oligonucleotides
tgaagtcgcactagaaa

SEQ ID NO: 602 - DNA, 18 bp, Artificial
  Antisense Oligonucleotides
atgaagtcgcactagaaa

SEQ ID NO: 603 - DNA, 19 bp, Artificial
  Antisense Oligonucleotides
catgaagtcgcactagaaa

SEQ ID NO: 604 - DNA, 16 bp, Artificial
  Antisense Oligonucleotides
tgaagtcgcactagaa

SEQ ID NO: 605 - DNA, 17 bp, Artificial
  Antisense Oligonucleotides
atgaagtcgcactagaa

SEQ ID NO: 606 - DNA, 18 bp, Artificial
  Antisense Oligonucleotides
catgaagtcgcactagaa

SEQ ID NO: 607 - DNA, 18 bp, Artificial
  Antisense Oligonucleotides
caaatcaaacaccaagta

SEQ ID NO: 608 - DNA, 19 bp, Artificial
  Antisense Oligonucleotides
acaaatcaaacaccaagta

SEQ ID NO: 609 - DNA, 19 bp, Artificial
  Antisense Oligonucleotides
tacaaatcaaacaccaagt

SEQ ID NO: 610 - DNA, 20 bp, Artificial
  Antisense Oligonucleotides
ttacaaatcaaacaccaagt

SEQ ID NO: 611 - DNA, 20 bp, Artificial
  Antisense Oligonucleotides
acttacaaatcaaacaccaa

SEQ ID NO: 612 - DNA, 19 bp, Artificial
  Antisense Oligonucleotides
acttacaaatcaaacacca

SEQ ID NO: 613 - DNA, 20 bp, Artificial
  Antisense Oligonucleotides
tacttacaaatcaaacacca

SEQ ID NO: 614 - DNA, 18 bp, Artificial
  Antisense Oligonucleotides
acttacaaatcaaacacc

SEQ ID NO: 615 - DNA, 19 bp, Artificial
  Antisense Oligonucleotides
tacttacaaatcaaacacc

SEQ ID NO: 616 - DNA, 20 bp, Artificial
  Antisense Oligonucleotides
atacttacaaatcaaacacc

SEQ ID NO: 617 - DNA, 18 bp, Artificial
  Antisense Oligonucleotides
tacttacaaatcaaacac

SEQ ID NO: 618 - DNA, 19 bp, Artificial
  Antisense Oligonucleotides
atacttacaaatcaaacac

SEQ ID NO: 619 - DNA, 20 bp, Artificial
  Antisense Oligonucleotides
tatacttacaaatcaaacac

SEQ ID NO: 620 - DNA, 19 bp, Artificial
  Antisense Oligonucleotides
tatacttacaaatcaaaca

SEQ ID NO: 621 - DNA, 20 bp, Artificial
  Antisense Oligonucleotides
atatacttacaaatcaaaca

SEQ ID NO: 622 - DNA, 19 bp, Artificial
  Antisense Oligonucleotides
cattattttcccttcattc

SEQ ID NO: 623 - DNA, 17 bp, Artificial
  Antisense Oligonucleotides
ttctctataattggatc

SEQ ID NO: 624 - DNA, 20 bp, Artificial
  Antisense Oligonucleotides
agttgtaatttcattccctt

SEQ ID NO: 625 - DNA, 17 bp, Artificial
  Antisense Oligonucleotides
ccagttgtaatttcatt

SEQ ID NO: 626 - DNA, 19 bp, Artificial
  Antisense Oligonucleotides
tcaaacattggaaaggaag

SEQ ID NO: 627 - DNA, 17 bp, Artificial
  Antisense Oligonucleotides
tcaaacattggaaagga

SEQ ID NO: 628 - DNA, 20 bp, Artificial
  Antisense Oligonucleotides
gacagaacaataataaatta

SEQ ID NO: 629 - DNA, 20 bp, Artificial
  Antisense Oligonucleotides
cagaggaaagaattagacaa

SEQ ID NO: 630 - DNA, 19 bp, Artificial
  Antisense Oligonucleotides
agataatcaacaggcagca

SEQ ID NO: 631 - DNA, 19 bp, Artificial
  Antisense Oligonucleotides
aagataatcaacaggcagc

SEQ ID NO: 632 - DNA, 17 bp, Artificial
  Antisense Oligonucleotides
agataatcaacaggcag

SEQ ID NO: 633 - DNA, 18 bp, Artificial
  Antisense Oligonucleotides
gttaatctctctcttgtt

SEQ ID NO: 634 - DNA, 17 bp, Artificial
  Antisense Oligonucleotides
tttccataagtcaattc

SEQ ID NO: 635 - DNA, 19 bp, Artificial
  Antisense Oligonucleotides
atgactgtggaaaactggc

SEQ ID NO: 636 - DNA, 19 bp, Artificial
  Antisense Oligonucleotides
tttattaatctcatttact

SEQ ID NO: 637 - DNA, 19 bp, Artificial
  Antisense Oligonucleotides
caagtagttattttatctc

SEQ ID NO: 638 - DNA, 18 bp, Artificial
  Antisense Oligonucleotides
attcaagtagttatttta

SEQ ID NO: 639 - DNA, 18 bp, Artificial
  Antisense Oligonucleotides
caatttgctgttcctata

SEQ ID NO: 640 - DNA, 18 bp, Artificial
  Antisense Oligonucleotides
acactattttagttcttt

SEQ ID NO: 641 - DNA, 17 bp, Artificial
  Antisense Oligonucleotides
ctcagctatgttctata

SEQ ID NO: 642 - DNA, 18 bp, Artificial
  Antisense Oligonucleotides
ttttatgtagattaactg

SEQ ID NO: 643 - DNA, 20 bp, Artificial
  Antisense Oligonucleotides
taatcgtgtattttgccttc

SEQ ID NO: 644 - DNA, 18 bp, Artificial
  Antisense Oligonucleotides
ttaatcgtgtattttgcc

SEQ ID NO: 645 - DNA, 17 bp, Artificial
  Antisense Oligonucleotides
agttaatcgtgtatttt

SEQ ID NO: 646 - DNA, 18 bp, Artificial
  Antisense Oligonucleotides
taaggaggacagaacagg

SEQ ID NO: 647 - DNA, 19 bp, Artificial
  Antisense Oligonucleotides
atctaaaaggttatatact

SEQ ID NO: 648 - DNA, 18 bp, Artificial
  Antisense Oligonucleotides
aggaaataagctataagg

SEQ ID NO: 649 - DNA, 18 bp, Artificial
  Antisense Oligonucleotides
gctatggagacagtatgg

SEQ ID NO: 650 - DNA, 18 bp, Artificial
  Antisense Oligonucleotides
caaaggtaaagctatgga

SEQ ID NO: 651 - DNA, 20 bp, Artificial
  Antisense Oligonucleotides
tagaagactgacactactca

SEQ ID NO: 652 - DNA, 19 bp, Artificial
  Antisense Oligonucleotides
gatagaagactgacactac

SEQ ID NO: 653 - DNA, 17 bp, Artificial
  Antisense Oligonucleotides
gatagaagactgacact

SEQ ID NO: 654 - DNA, 18 bp, Artificial
  Antisense Oligonucleotides
agttatttattggtttaa

SEQ ID NO: 655 - DNA, 19 bp, Artificial
  Antisense Oligonucleotides
cttaaggaaatgttataac

SEQ ID NO: 656 - DNA, 18 bp, Artificial
  Antisense Oligonucleotides
attgagtacaggcagagt

SEQ ID NO: 657 - DNA, 19 bp, Artificial
  Antisense Oligonucleotides
atttattgagtacaggcag

SEQ ID NO: 658 - DNA, 19 bp, Artificial
  Antisense Oligonucleotides
gtcttcatgctattttcac

SEQ ID NO: 659 - DNA, 20 bp, Artificial
  Antisense Oligonucleotides
atggtctattaaatgtgcaa

SEQ ID NO: 660 - DNA, 18 bp, Artificial
  Antisense Oligonucleotides
agcagtgatacaagggac

SEQ ID NO: 661 - DNA, 17 bp, Artificial
  Antisense Oligonucleotides
gagattatccttcaaat

SEQ ID NO: 662 - DNA, 18 bp, Artificial
  Antisense Oligonucleotides
tgggaatagtggaaggag

SEQ ID NO: 663 - DNA, 18 bp, Artificial
  Antisense Oligonucleotides
gatgatgtaaacagagag

SEQ ID NO: 664 - DNA, 18 bp, Artificial
  Antisense Oligonucleotides
caggtggatgatgtaaac

SEQ ID NO: 665 - DNA, 20 bp, Artificial
  Antisense Oligonucleotides
tattgaaggcttatttacca

SEQ ID NO: 666 - DNA, 18 bp, Artificial
  Antisense Oligonucleotides
tattgaaggcttatttac

SEQ ID NO: 667 - DNA, 20 bp, Artificial
  Antisense Oligonucleotides
tttaactgatgaattgctga

SEQ ID NO: 668 - DNA, 20 bp, Artificial
  Antisense Oligonucleotides
ccttgcttgtattttcaaat

SEQ ID NO: 669 - DNA, 19 bp, Artificial
  Antisense Oligonucleotides
tttacatttaattaacttt

SEQ ID NO: 670 - DNA, 19 bp, Artificial
  Antisense Oligonucleotides
ccatgattttacatttaat

SEQ ID NO: 671 - DNA, 18 bp, Artificial
  Antisense Oligonucleotides
ctgggagatgaaatggat

SEQ ID NO: 672 - DNA, 18 bp, Artificial
  Antisense Oligonucleotides
agagaatgtctaaagtac

SEQ ID NO: 673 - DNA, 18 bp, Artificial
  Antisense Oligonucleotides
gatttctctaaatgtgta

SEQ ID NO: 674 - DNA, 19 bp, Artificial
  Antisense Oligonucleotides
ttaattactctctaaactt

SEQ ID NO: 675 - DNA, 18 bp, Artificial
  Antisense Oligonucleotides
aaatctgcttgtttgtca

SEQ ID NO: 676 - DNA, 18 bp, Artificial
  Antisense Oligonucleotides
gctcaataattgcttcta

SEQ ID NO: 677 - DNA, 17 bp, Artificial
  Antisense Oligonucleotides
tgatagtatattggttt

SEQ ID NO: 678 - DNA, 20 bp, Artificial
  Antisense Oligonucleotides
taaatgaatgtagaatctta

SEQ ID NO: 679 - DNA, 20 bp, Artificial
  Antisense Oligonucleotides
agatggaataatttaaagcc

SEQ ID NO: 680 - DNA, 17 bp, Artificial
  Antisense Oligonucleotides
gaactgttttagatatc

SEQ ID NO: 681 - DNA, 17 bp, Artificial
  Antisense Oligonucleotides
agactatatgaaggtga

SEQ ID NO: 682 - DNA, 18 bp, Artificial
  Antisense Oligonucleotides
ataaattaattcatggta

SEQ ID NO: 683 - DNA, 17 bp, Artificial
  Antisense Oligonucleotides
atagttggtaatataga

SEQ ID NO: 684 - DNA, 18 bp, Artificial
  Antisense Oligonucleotides
tttcatttcttaaaacgt

SEQ ID NO: 685 - DNA, 19 bp, Artificial
  Antisense Oligonucleotides
agggttgaatagttttcag

SEQ ID NO: 686 - DNA, 19 bp, Artificial
  Antisense Oligonucleotides
cagatcagtaggtttcttt

SEQ ID NO: 687 - DNA, 17 bp, Artificial
  Antisense Oligonucleotides
cagatcagtaggtttct

SEQ ID NO: 688 - DNA, 17 bp, Artificial
  Antisense Oligonucleotides
ctgaaggattgaggttg

SEQ ID NO: 689 - DNA, 17 bp, Artificial
  Antisense Oligonucleotides
tatatgcttgtcagttt

SEQ ID NO: 690 - DNA, 18 bp, Artificial
  Antisense Oligonucleotides
tattttacagttgttcat

SEQ ID NO: 691 - DNA, 17 bp, Artificial
  Antisense Oligonucleotides
gctggttatagtaataa

SEQ ID NO: 692 - DNA, 19 bp, Artificial
  Antisense Oligonucleotides
tgatgtaagcctggaactg

SEQ ID NO: 693 - DNA, 17 bp, Artificial
  Antisense Oligonucleotides
gtaagaatgatgtaagc

SEQ ID NO: 694 - DNA, 20 bp, Artificial
  Antisense Oligonucleotides
tatagtatagattagtatat

SEQ ID NO: 695 - DNA, 20 bp, Artificial
  Antisense Oligonucleotides
gtatagtatagattagtata

SEQ ID NO: 696 - DNA, 19 bp, Artificial
  Antisense Oligonucleotides
gtatagtatagattagtat

SEQ ID NO: 697 - DNA, 20 bp, Artificial
  Antisense Oligonucleotides
agtatagtatagattagtat

SEQ ID NO: 698 - DNA, 18 bp, Artificial
  Antisense Oligonucleotides
gtatagtatagattagta

SEQ ID NO: 699 - DNA, 19 bp, Artificial
  Antisense Oligonucleotides
agtatagtatagattagta

SEQ ID NO: 700 - DNA, 17 bp, Artificial
  Antisense Oligonucleotides
gtatagtatagattagt

SEQ ID NO: 701 - DNA, 18 bp, Artificial
  Antisense Oligonucleotides
agtatagtatagattagt

SEQ ID NO: 702 - DNA, 17 bp, Artificial
  Antisense Oligonucleotides
agtatagtatagattag

SEQ ID NO: 703 - DNA, 18 bp, Artificial
  Antisense Oligonucleotides
atgactgaattaaatatg

SEQ ID NO: 704 - DNA, 18 bp, Artificial
  Antisense Oligonucleotides
gtgcattaaattatctat

SEQ ID NO: 705 - DNA, 19 bp, Artificial
  Antisense Oligonucleotides
gctacatataatgaggaaa

SEQ ID NO: 706 - DNA, 20 bp, Artificial
  Antisense Oligonucleotides
tggtttatgcaggaagaaga

SEQ ID NO: 707 - DNA, 18 bp, Artificial
  Antisense Oligonucleotides
aaagggataattaagtga

SEQ ID NO: 708 - DNA, 17 bp, Artificial
  Antisense Oligonucleotides
ttaatcattggctgggg

SEQ ID NO: 709 - DNA, 17 bp, Artificial
  Antisense Oligonucleotides
gtttaacttatatacag

SEQ ID NO: 710 - DNA, 18 bp, Artificial
  Antisense Oligonucleotides
gaatttgaataaaagcct

SEQ ID NO: 711 - DNA, 19 bp, Artificial
  Antisense Oligonucleotides
aagaatttgaataaaagcc

SEQ ID NO: 712 - DNA, 19 bp, Artificial
  Antisense Oligonucleotides
atgctaaattttatcttga

SEQ ID NO: 713 - DNA, 18 bp, Artificial
  Antisense Oligonucleotides
ctaattttaaattgctgc

SEQ ID NO: 714 - DNA, 19 bp, Artificial
  Antisense Oligonucleotides
tctaattttaaattgctgc

SEQ ID NO: 715 - DNA, 20 bp, Artificial
  Antisense Oligonucleotides
ttctaattttaaattgctgc

SEQ ID NO: 716 - DNA, 19 bp, Artificial
  Antisense Oligonucleotides
ttctaattttaaattgctg

SEQ ID NO: 717 - DNA, 20 bp, Artificial
  Antisense Oligonucleotides
cttctaattttaaattgctg

SEQ ID NO: 718 - DNA, 19 bp, Artificial
  Antisense Oligonucleotides
cttctaattttaaattgct

SEQ ID NO: 719 - DNA, 20 bp, Artificial
  Antisense Oligonucleotides
gcttctaattttaaattgct

SEQ ID NO: 720 - DNA, 19 bp, Artificial
  Antisense Oligonucleotides
gcttctaattttaaattgc

SEQ ID NO: 721 - DNA, 17 bp, Artificial
  Antisense Oligonucleotides
ttataagctttagacag

SEQ ID NO: 722 - DNA, 19 bp, Artificial
  Antisense Oligonucleotides
ttaacctgaatttattgag

SEQ ID NO: 723 - DNA, 17 bp, Artificial
  Antisense Oligonucleotides
atgaataggataggggt

SEQ ID NO: 724 - DNA, 18 bp, Artificial
  Antisense Oligonucleotides
agtcagataattcaatta

SEQ ID NO: 725 - DNA, 18 bp, Artificial
  Antisense Oligonucleotides
agctatattaagtaaaag

SEQ ID NO: 726 - DNA, 17 bp, Artificial
  Antisense Oligonucleotides
ttaatataaggaggtag

SEQ ID NO: 727 - DNA, 20 bp, Artificial
  Antisense Oligonucleotides
taattttattaatataagga

SEQ ID NO: 728 - DNA, 20 bp, Artificial
  Antisense Oligonucleotides
agattatcaggattaaatga

SEQ ID NO: 729 - DNA, 19 bp, Artificial
  Antisense Oligonucleotides
agattatcaggattaaatg

SEQ ID NO: 730 - DNA, 18 bp, Artificial
  Antisense Oligonucleotides
ccatgaccttattaatga

SEQ ID NO: 731 - DNA, 17 bp, Artificial
  Antisense Oligonucleotides
ccatgaccttattaatg

SEQ ID NO: 732 - DNA, 18 bp, Artificial
  Antisense Oligonucleotides
aaattgttgcttctcatc

SEQ ID NO: 733 - DNA, 17 bp, Artificial
  Antisense Oligonucleotides
ttttggagactaagcta

SEQ ID NO: 734 - DNA, 20 bp, Artificial
  Antisense Oligonucleotides
ttcatatcagttcaaaatga

SEQ ID NO: 735 - DNA, 17 bp, Artificial
  Antisense Oligonucleotides
attgtcaggattgggtc

SEQ ID NO: 736 - DNA, 18 bp, Artificial
  Antisense Oligonucleotides
tatttggttatttgtgag

SEQ ID NO: 737 - DNA, 18 bp, Artificial
  Antisense Oligonucleotides
atttgcataaatgttgtg

SEQ ID NO: 738 - DNA, 18 bp, Artificial
  Antisense Oligonucleotides
ccttgtattttgtctgtt

SEQ ID NO: 739 - DNA, 18 bp, Artificial
  Antisense Oligonucleotides
ttaaaagtttatcagctt

SEQ ID NO: 740 - DNA, 18 bp, Artificial
  Antisense Oligonucleotides
ttgtttagtattcatttc

SEQ ID NO: 741 - DNA, 17 bp, Artificial
  Antisense Oligonucleotides
gaggctagaataatttg

SEQ ID NO: 742 - DNA, 18 bp, Artificial
  Antisense Oligonucleotides
acaatgaagaatagtata

SEQ ID NO: 743 - DNA, 17 bp, Artificial
  Antisense Oligonucleotides
tgtggaataaagtgcat

SEQ ID NO: 744 - DNA, 17 bp, Artificial
  Antisense Oligonucleotides
ttgtggaataaagtgca

SEQ ID NO: 745 - DNA, 20 bp, Artificial
  Antisense Oligonucleotides
tactttaaatttctctgaat

SEQ ID NO: 746 - DNA, 19 bp, Artificial
  Antisense Oligonucleotides
tattctactcatttgctgt

SEQ ID NO: 747 - DNA, 17 bp, Artificial
  Antisense Oligonucleotides
tgtaggctgttaaacta

SEQ ID NO: 748 - DNA, 20 bp, Artificial
  Antisense Oligonucleotides
atttgattccataaatagca

SEQ ID NO: 749 - DNA, 19 bp, Artificial
  Antisense Oligonucleotides
atttgattccataaatagc

SEQ ID NO: 750 - DNA, 19 bp, Artificial
  Antisense Oligonucleotides
tacaaatatattcttcaca

SEQ ID NO: 751 - DNA, 19 bp, Artificial
  Antisense Oligonucleotides
tctcctttctacaaatata

SEQ ID NO: 752 - DNA, 17 bp, Artificial
  Antisense Oligonucleotides
gttgtttgaggtaatct

SEQ ID NO: 753 - DNA, 20 bp, Artificial
  Antisense Oligonucleotides
aggactggacttaatacatt

SEQ ID NO: 754 - DNA, 17 bp, Artificial
  Antisense Oligonucleotides
aggactggacttaatac

SEQ ID NO: 755 - DNA, 18 bp, Artificial
  Antisense Oligonucleotides
acactggaatgaaatttt

SEQ ID NO: 756 - DNA, 20 bp, Artificial
  Antisense Oligonucleotides
ataagaattgtgttgataaa

SEQ ID NO: 757 - DNA, 17 bp, Artificial
  Antisense Oligonucleotides
cctaattcctgaaagat

SEQ ID NO: 758 - DNA, 18 bp, Artificial
  Antisense Oligonucleotides
ctagttatctatctgtat

SEQ ID NO: 759 - DNA, 19 bp, Artificial
  Antisense Oligonucleotides
ataagaaacaaacaactca

SEQ ID NO: 760 - DNA, 20 bp, Artificial
  Antisense Oligonucleotides
tgttgtttaattaagttcat

SEQ ID NO: 761 - DNA, 18 bp, Artificial
  Antisense Oligonucleotides
aatgttgtttaattaagt

SEQ ID NO: 762 - DNA, 20 bp, Artificial
  Antisense Oligonucleotides
taaatttgagcaaagagatg

SEQ ID NO: 763 - DNA, 18 bp, Artificial
  Antisense Oligonucleotides
aaaggaataaatttgagc

SEQ ID NO: 764 - DNA, 20 bp, Artificial
  Antisense Oligonucleotides
gttttgttctaataattctg

SEQ ID NO: 765 - DNA, 19 bp, Artificial
  Antisense Oligonucleotides
cttgtgcttttgtgtcata

SEQ ID NO: 766 - DNA, 18 bp, Artificial
  Antisense Oligonucleotides
gttgttaagttacagaag

SEQ ID NO: 767 - DNA, 20 bp, Artificial
  Antisense Oligonucleotides
aatgatgagtaatgttgagt

SEQ ID NO: 768 - DNA, 18 bp, Artificial
  Antisense Oligonucleotides
attcaatatttgtgcttt

SEQ ID NO: 769 - DNA, 17 bp, Artificial
  Antisense Oligonucleotides
accattcaatatttgtg

SEQ ID NO: 770 - DNA, 19 bp, Artificial
  Antisense Oligonucleotides
tgtaaaattaaagagctaa

SEQ ID NO: 771 - DNA, 19 bp, Artificial
  Antisense Oligonucleotides
gcaaatatggatgaaattt

SEQ ID NO: 772 - DNA, 19 bp, Artificial
  Antisense Oligonucleotides
catttactcattatccatc

SEQ ID NO: 773 - DNA, 19 bp, Artificial
  Antisense Oligonucleotides
atatctaaattcctctttc

SEQ ID NO: 774 - DNA, 18 bp, Artificial
  Antisense Oligonucleotides
gtagagttcagtcatttt

SEQ ID NO: 775 - DNA, 19 bp, Artificial
  Antisense Oligonucleotides
ttcttttcaatattatctt

SEQ ID NO: 776 - DNA, 17 bp, Artificial
  Antisense Oligonucleotides
gtagaggctattaatga

SEQ ID NO: 777 - DNA, 19 bp, Artificial
  Antisense Oligonucleotides
tacaacaaattaaagaggg

SEQ ID NO: 778 - DNA, 18 bp, Artificial
  Antisense Oligonucleotides
tttgtgaaagagaacagg

SEQ ID NO: 779 - DNA, 18 bp, Artificial
  Antisense Oligonucleotides
agatgaggaatatgatgg

SEQ ID NO: 780 - DNA, 20 bp, Artificial
  Antisense Oligonucleotides
tattagatgaggaatatgat

SEQ ID NO: 781 - DNA, 20 bp, Artificial
  Antisense Oligonucleotides
ttgtttgatttaaatttcac

SEQ ID NO: 782 - DNA, 19 bp, Artificial
  Antisense Oligonucleotides
caatcttgatttaattttc

SEQ ID NO: 783 - DNA, 17 bp, Artificial
  Antisense Oligonucleotides
tgatggagataactagt

SEQ ID NO: 784 - DNA, 18 bp, Artificial
  Antisense Oligonucleotides
tagtttggtggatggtgc

SEQ ID NO: 785 - DNA, 20 bp, Artificial
  Antisense Oligonucleotides
aatgtgtgggttttctttca

SEQ ID NO: 786 - DNA, 20 bp, Artificial
  Antisense Oligonucleotides
tatttaatttaatgaatgcc

SEQ ID NO: 787 - DNA, 19 bp, Artificial
  Antisense Oligonucleotides
atatatggctttatttaat

SEQ ID NO: 788 - DNA, 17 bp, Artificial
  Antisense Oligonucleotides
attgaggtaagtctaga

SEQ ID NO: 789 - DNA, 19 bp, Artificial
  Antisense Oligonucleotides
ttatctaaaatcttattta

SEQ ID NO: 790 - DNA, 18 bp, Artificial
  Antisense Oligonucleotides
aatggtttattgtatgtg

SEQ ID NO: 791 - DNA, 17 bp, Artificial
  Antisense Oligonucleotides
ctacagggacttacaag

SEQ ID NO: 792 - DNA, 18 bp, Artificial
  Antisense Oligonucleotides
atattttattactacagg

SEQ ID NO: 793 - DNA, 19 bp, Artificial
  Antisense Oligonucleotides
gagaggagagaataatgaa

SEQ ID NO: 794 - DNA, 18 bp, Artificial
  Antisense Oligonucleotides
tactgttactgttgatcc

SEQ ID NO: 795 - DNA, 20 bp, Artificial
  Antisense Oligonucleotides
gaggagatactgttactgtt

SEQ ID NO: 796 - DNA, 20 bp, Artificial
  Antisense Oligonucleotides
ttctaacatatttctaatca

SEQ ID NO: 797 - DNA, 19 bp, Artificial
  Antisense Oligonucleotides
taattcatctaaaagttag

SEQ ID NO: 798 - DNA, 18 bp, Artificial
  Antisense Oligonucleotides
tattaactattggaattc

SEQ ID NO: 799 - DNA, 18 bp, Artificial
  Antisense Oligonucleotides
atgtattaactattggaa

SEQ ID NO: 800 - DNA, 20 bp, Artificial
  Antisense Oligonucleotides
atatcagggacttcagtatc

SEQ ID NO: 801 - DNA, 18 bp, Artificial
  Antisense Oligonucleotides
ttttaattcttgaagtca

SEQ ID NO: 802 - DNA, 17 bp, Artificial
  Antisense Oligonucleotides
cagttttcataatcacc

SEQ ID NO: 803 - DNA, 17 bp, Artificial
  Antisense Oligonucleotides
cgtatattatgagcatg

SEQ ID NO: 804 - DNA, 18 bp, Artificial
  Antisense Oligonucleotides
atttgtatcccacctatc

SEQ ID NO: 805 - DNA, 17 bp, Artificial
  Antisense Oligonucleotides
gcttaatttgtatccca

SEQ ID NO: 806 - DNA, 19 bp, Artificial
  Antisense Oligonucleotides
gtgaataagtgattaaata

SEQ ID NO: 807 - DNA, 17 bp, Artificial
  Antisense Oligonucleotides
tatggggatacaatgaa

SEQ ID NO: 808 - DNA, 17 bp, Artificial
  Antisense Oligonucleotides
agtaatggagattaagg

SEQ ID NO: 809 - DNA, 20 bp, Artificial
  Antisense Oligonucleotides
gagaaatgtctgttgttcaa

SEQ ID NO: 810 - DNA, 19 bp, Artificial
  Antisense Oligonucleotides
aggcagaagttgtaatggt

SEQ ID NO: 811 - DNA, 19 bp, Artificial
  Antisense Oligonucleotides
aaggcagaagttgtaatgg

SEQ ID NO: 812 - DNA, 18 bp, Artificial
  Antisense Oligonucleotides
atttcatcagtaatagat

SEQ ID NO: 813 - DNA, 18 bp, Artificial
  Antisense Oligonucleotides
ttagagattttgtgaata

SEQ ID NO: 814 - DNA, 19 bp, Artificial
  Antisense Oligonucleotides
attttctaactttaacata

SEQ ID NO: 815 - DNA, 20 bp, Artificial
  Antisense Oligonucleotides
tactgatctttgttatgtta

SEQ ID NO: 816 - DNA, 17 bp, Artificial
  Antisense Oligonucleotides
cttactgatctttgtta

SEQ ID NO: 817 - DNA, 20 bp, Artificial
  Antisense Oligonucleotides
ttttgctttattaagttctg

SEQ ID NO: 818 - DNA, 18 bp, Artificial
  Antisense Oligonucleotides
gagtgagataaaaggatg

SEQ ID NO: 819 - DNA, 18 bp, Artificial
  Antisense Oligonucleotides
gaatttcttggttattag

SEQ ID NO: 820 - DNA, 17 bp, Artificial
  Antisense Oligonucleotides
aattttgtagagcagac

SEQ ID NO: 821 - DNA, 19 bp, Artificial
  Antisense Oligonucleotides
ttgccactatgtcttcaaa

SEQ ID NO: 822 - DNA, 17 bp, Artificial
  Antisense Oligonucleotides
tgccactatgtcttcaa

SEQ ID NO: 823 - DNA, 18 bp, Artificial
  Antisense Oligonucleotides
ttgccactatgtcttcaa

SEQ ID NO: 824 - DNA, 17 bp, Artificial
  Antisense Oligonucleotides
ttgccactatgtcttca

SEQ ID NO: 825 - DNA, 17 bp, Artificial
  Antisense Oligonucleotides
cacttacctggcatcag

SEQ ID NO: 826 - DNA, 20 bp, Artificial
  Antisense Oligonucleotides
ttgataaaatatgtaatcta

SEQ ID NO: 827 - DNA, 20 bp, Artificial
  Antisense Oligonucleotides
ttagatattcattgttcagt

SEQ ID NO: 828 - DNA, 18 bp, Artificial
  Antisense Oligonucleotides
aagggttttaatgaaatt

SEQ ID NO: 829 - DNA, 20 bp, Artificial
  Antisense Oligonucleotides
acagaatatataaaagtaca

SEQ ID NO: 830 - DNA, 19 bp, Artificial
  Antisense Oligonucleotides
tacagaatatataaaagta

SEQ ID NO: 831 - DNA, 17 bp, Artificial
  Antisense Oligonucleotides
tttggggtaaactgagc

SEQ ID NO: 832 - DNA, 18 bp, Artificial
  Antisense Oligonucleotides
ttttaatttcaaccagta

SEQ ID NO: 833 - DNA, 17 bp, Artificial
  Antisense Oligonucleotides
ctagtgagaatggattc

SEQ ID NO: 834 - DNA, 17 bp, Artificial
  Antisense Oligonucleotides
taaaccataggaatctt

SEQ ID NO: 835 - DNA, 18 bp, Artificial
  Antisense Oligonucleotides
ttgtataagttcactgtg

SEQ ID NO: 836 - DNA, 20 bp, Artificial
  Antisense Oligonucleotides
agtatataacaggaaaacaa

SEQ ID NO: 837 - DNA, 18 bp, Artificial
  Antisense Oligonucleotides
aaaggcacataatcacat

SEQ ID NO: 838 - DNA, 19 bp, Artificial
  Antisense Oligonucleotides
taaaggcacataatcacat

SEQ ID NO: 839 - DNA, 17 bp, Artificial
  Antisense Oligonucleotides
taaaggcacataatcac

SEQ ID NO: 840 - DNA, 20 bp, Artificial
  Antisense Oligonucleotides
attttaaaggcacataatca

SEQ ID NO: 841 - DNA, 20 bp, Artificial
  Antisense Oligonucleotides
cattttaaaggcacataatc

SEQ ID NO: 842 - DNA, 19 bp, Artificial
  Antisense Oligonucleotides
cattttaaaggcacataat

SEQ ID NO: 843 - DNA, 20 bp, Artificial
  Antisense Oligonucleotides
acattttaaaggcacataat

SEQ ID NO: 844 - DNA, 19 bp, Artificial
  Antisense Oligonucleotides
acattttaaaggcacataa

SEQ ID NO: 845 - DNA, 20 bp, Artificial
  Antisense Oligonucleotides
aacattttaaaggcacataa

SEQ ID NO: 846 - DNA, 19 bp, Artificial
  Antisense Oligonucleotides
aacattttaaaggcacata

SEQ ID NO: 847 - DNA, 20 bp, Artificial
  Antisense Oligonucleotides
gaacattttaaaggcacata

SEQ ID NO: 848 - DNA, 19 bp, Artificial
  Antisense Oligonucleotides
gaacattttaaaggcacat

SEQ ID NO: 849 - DNA, 20 bp, Artificial
  Antisense Oligonucleotides
agaacattttaaaggcacat

SEQ ID NO: 850 - DNA, 19 bp, Artificial
  Antisense Oligonucleotides
agaacattttaaaggcaca

SEQ ID NO: 851 - DNA, 20 bp, Artificial
  Antisense Oligonucleotides
gagaacattttaaaggcaca

SEQ ID NO: 852 - DNA, 19 bp, Artificial
  Antisense Oligonucleotides
gagaacattttaaaggcac

SEQ ID NO: 853 - DNA, 20 bp, Artificial
  Antisense Oligonucleotides
agggagaacattttaaaggc

SEQ ID NO: 854 - DNA, 19 bp, Artificial
  Antisense Oligonucleotides
agggagaacattttaaagg

SEQ ID NO: 855 - DNA, 18 bp, Artificial
  Antisense Oligonucleotides
agggagaacattttaaag

SEQ ID NO: 856 - DNA, 18 bp, Artificial
  Antisense Oligonucleotides
atggaagggagaacattt

SEQ ID NO: 857 - DNA, 19 bp, Artificial
  Antisense Oligonucleotides
caaagatacaagggcagaa

SEQ ID NO: 858 - DNA, 18 bp, Artificial
  Antisense Oligonucleotides
caaagatacaagggcaga

SEQ ID NO: 859 - DNA, 18 bp, Artificial
  Antisense Oligonucleotides
actgcaaagatacaaggg

SEQ ID NO: 860 - DNA, 19 bp, Artificial
  Antisense Oligonucleotides
gactgcaaagatacaaggg

SEQ ID NO: 861 - DNA, 18 bp, Artificial
  Antisense Oligonucleotides
gactgcaaagatacaagg

SEQ ID NO: 862 - DNA, 19 bp, Artificial
  Antisense Oligonucleotides
tgactgcaaagatacaagg

SEQ ID NO: 863 - DNA, 20 bp, Artificial
  Antisense Oligonucleotides
atgactgcaaagatacaagg

SEQ ID NO: 864 - DNA, 18 bp, Artificial
  Antisense Oligonucleotides
tgactgcaaagatacaag

SEQ ID NO: 865 - DNA, 19 bp, Artificial
  Antisense Oligonucleotides
atgactgcaaagatacaag

SEQ ID NO: 866 - DNA, 20 bp, Artificial
  Antisense Oligonucleotides
aatgactgcaaagatacaag

SEQ ID NO: 867 - DNA, 20 bp, Artificial
  Antisense Oligonucleotides
caatgactgcaaagatacaa

SEQ ID NO: 868 - DNA, 19 bp, Artificial
  Antisense Oligonucleotides
caatgactgcaaagataca

SEQ ID NO: 869 - DNA, 20 bp, Artificial
  Antisense Oligonucleotides
acaatgactgcaaagataca

SEQ ID NO: 870 - DNA, 19 bp, Artificial
  Antisense Oligonucleotides
acaatgactgcaaagatac

SEQ ID NO: 871 - DNA, 19 bp, Artificial
  Antisense Oligonucleotides
tacaatgactgcaaagata

SEQ ID NO: 872 - DNA, 20 bp, Artificial
  Antisense Oligonucleotides
tatacaatgactgcaaagat

SEQ ID NO: 873 - DNA, 18 bp, Artificial
  Antisense Oligonucleotides
tatacaatgactgcaaag

SEQ ID NO: 874 - DNA, 17 bp, Artificial
  Antisense Oligonucleotides
aactatgccatttaggt

SEQ ID NO: 875 - DNA, 18 bp, Artificial
  Antisense Oligonucleotides
gaactatgccatttaggt

SEQ ID NO: 876 - DNA, 20 bp, Artificial
  Antisense Oligonucleotides
gtgaactatgccatttaggt

SEQ ID NO: 877 - DNA, 17 bp, Artificial
  Antisense Oligonucleotides
gaactatgccatttagg

SEQ ID NO: 878 - DNA, 18 bp, Artificial
  Antisense Oligonucleotides
tgaactatgccatttagg

SEQ ID NO: 879 - DNA, 19 bp, Artificial
  Antisense Oligonucleotides
gtgaactatgccatttagg

SEQ ID NO: 880 - DNA, 18 bp, Artificial
  Antisense Oligonucleotides
gtgaactatgccatttag

SEQ ID NO: 881 - DNA, 19 bp, Artificial
  Antisense Oligonucleotides
tgtgaactatgccatttag

SEQ ID NO: 882 - DNA, 20 bp, Artificial
  Antisense Oligonucleotides
ctgtgaactatgccatttag

SEQ ID NO: 883 - DNA, 17 bp, Artificial
  Antisense Oligonucleotides
gtgaactatgccattta

SEQ ID NO: 884 - DNA, 18 bp, Artificial
  Antisense Oligonucleotides
tgtgaactatgccattta

SEQ ID NO: 885 - DNA, 19 bp, Artificial
  Antisense Oligonucleotides
ctgtgaactatgccattta

SEQ ID NO: 886 - DNA, 17 bp, Artificial
  Antisense Oligonucleotides
cctgtgaactatgccat

SEQ ID NO: 887 - DNA, 16 bp, Artificial
  Antisense Oligonucleotides
ccctgtgaactatgcc

SEQ ID NO: 888 - DNA, 17 bp, Artificial
  Antisense Oligonucleotides
ccatatactgaccttca

SEQ ID NO: 889 - DNA, 18 bp, Artificial
  Antisense Oligonucleotides
tccatatactgaccttca

SEQ ID NO: 890 - DNA, 17 bp, Artificial
  Antisense Oligonucleotides
tccatatactgaccttc

SEQ ID NO: 891 - DNA, 17 bp, Artificial
  Antisense Oligonucleotides
ctccatatactgacctt

SEQ ID NO: 892 - DNA, 18 bp, Artificial
  Antisense Oligonucleotides
actccatatactgacctt

SEQ ID NO: 893 - DNA, 17 bp, Artificial
  Antisense Oligonucleotides
actccatatactgacct

SEQ ID NO: 894 - DNA, 17 bp, Artificial
  Antisense Oligonucleotides
gactccatatactgacc

SEQ ID NO: 895 - DNA, 18 bp, Artificial
  Antisense Oligonucleotides
ttttgctatgatgtatat

SEQ ID NO: 896 - DNA, 19 bp, Artificial
  Antisense Oligonucleotides
aggcggacatacatcacag

SEQ ID NO: 897 - DNA, 20 bp, Artificial
  Antisense Oligonucleotides
caggcggacatacatcacag

SEQ ID NO: 898 - DNA, 18 bp, Artificial
  Antisense Oligonucleotides
aggcggacatacatcaca

SEQ ID NO: 899 - DNA, 19 bp, Artificial
  Antisense Oligonucleotides
caggcggacatacatcaca

SEQ ID NO: 900 - DNA, 17 bp, Artificial
  Antisense Oligonucleotides
aggcggacatacatcac

SEQ ID NO: 901 - DNA, 18 bp, Artificial
  Antisense Oligonucleotides
caggcggacatacatcac

SEQ ID NO: 902 - DNA, 19 bp, Artificial
  Antisense Oligonucleotides
acaggcggacatacatcac

SEQ ID NO: 903 - DNA, 20 bp, Artificial
  Antisense Oligonucleotides
tacaggcggacatacatcac

SEQ ID NO: 904 - DNA, 16 bp, Artificial
  Antisense Oligonucleotides
aggcggacatacatca

SEQ ID NO: 905 - DNA, 17 bp, Artificial
  Antisense Oligonucleotides
caggcggacatacatca

SEQ ID NO: 906 - DNA, 18 bp, Artificial
  Antisense Oligonucleotides
acaggcggacatacatca

SEQ ID NO: 907 - DNA, 19 bp, Artificial
  Antisense Oligonucleotides
tacaggcggacatacatca

SEQ ID NO: 908 - DNA, 16 bp, Artificial
  Antisense Oligonucleotides
caggcggacatacatc

SEQ ID NO: 909 - DNA, 17 bp, Artificial
  Antisense Oligonucleotides
acaggcggacatacatc

SEQ ID NO: 910 - DNA, 18 bp, Artificial
  Antisense Oligonucleotides
tacaggcggacatacatc

SEQ ID NO: 911 - DNA, 19 bp, Artificial
  Antisense Oligonucleotides
ctacaggcggacatacatc

SEQ ID NO: 912 - DNA, 17 bp, Artificial
  Antisense Oligonucleotides
tacaggcggacatacat

SEQ ID NO: 913 - DNA, 18 bp, Artificial
  Antisense Oligonucleotides
ctacaggcggacatacat

SEQ ID NO: 914 - DNA, 19 bp, Artificial
  Antisense Oligonucleotides
tctacaggcggacatacat

SEQ ID NO: 915 - DNA, 16 bp, Artificial
  Antisense Oligonucleotides
tacaggcggacataca

SEQ ID NO: 916 - DNA, 17 bp, Artificial
  Antisense Oligonucleotides
ctacaggcggacataca

SEQ ID NO: 917 - DNA, 18 bp, Artificial
  Antisense Oligonucleotides
tctacaggcggacataca

SEQ ID NO: 918 - DNA, 17 bp, Artificial
  Antisense Oligonucleotides
tctacaggcggacatac

SEQ ID NO: 919 - DNA, 16 bp, Artificial
  Antisense Oligonucleotides
tctacaggcggacata

SEQ ID NO: 920 - DNA, 16 bp, Artificial
  Antisense Oligonucleotides
aatctacaggcggaca

SEQ ID NO: 921 - DNA, 17 bp, Artificial
  Antisense Oligonucleotides
aaatctacaggcggaca

SEQ ID NO: 922 - DNA, 15 bp, Artificial
  Antisense Oligonucleotides
aatctacaggcggac

SEQ ID NO: 923 - DNA, 18 bp, Artificial
  Antisense Oligonucleotides
acagaagtggtgtttaaa

SEQ ID NO: 924 - DNA, 19 bp, Artificial
  Antisense Oligonucleotides
aacagaagtggtgtttaaa

SEQ ID NO: 925 - DNA, 18 bp, Artificial
  Antisense Oligonucleotides
aacagaagtggtgtttaa

SEQ ID NO: 926 - DNA, 19 bp, Artificial
  Antisense Oligonucleotides
tggttataaattcttccag

SEQ ID NO: 927 - DNA, 18 bp, Artificial
  Antisense Oligonucleotides
tggttataaattcttcca

SEQ ID NO: 928 - DNA, 19 bp, Artificial
  Antisense Oligonucleotides
ctggttataaattcttcca

SEQ ID NO: 929 - DNA, 20 bp, Artificial
  Antisense Oligonucleotides
cctggttataaattcttcca

SEQ ID NO: 930 - DNA, 18 bp, Artificial
  Antisense Oligonucleotides
ctggttataaattcttcc

SEQ ID NO: 931 - DNA, 19 bp, Artificial
  Antisense Oligonucleotides
cctggttataaattcttcc

SEQ ID NO: 932 - DNA, 18 bp, Artificial
  Antisense Oligonucleotides
cctggttataaattcttc

SEQ ID NO: 933 - DNA, 19 bp, Artificial
  Antisense Oligonucleotides
tcctggttataaattcttc

SEQ ID NO: 934 - DNA, 20 bp, Artificial
  Antisense Oligonucleotides
ttcctggttataaattcttc

SEQ ID NO: 935 - DNA, 18 bp, Artificial
  Antisense Oligonucleotides
tcctggttataaattctt

SEQ ID NO: 936 - DNA, 19 bp, Artificial
  Antisense Oligonucleotides
ttcctggttataaattctt

SEQ ID NO: 937 - DNA, 20 bp, Artificial
  Antisense Oligonucleotides
tttcctggttataaattctt

SEQ ID NO: 938 - DNA, 18 bp, Artificial
  Antisense Oligonucleotides
ttcctggttataaattct

SEQ ID NO: 939 - DNA, 19 bp, Artificial
  Antisense Oligonucleotides
tttcctggttataaattct

SEQ ID NO: 940 - DNA, 20 bp, Artificial
  Antisense Oligonucleotides
atttcctggttataaattct

SEQ ID NO: 941 - DNA, 17 bp, Artificial
  Antisense Oligonucleotides
ttcctggttataaattc

SEQ ID NO: 942 - DNA, 18 bp, Artificial
  Antisense Oligonucleotides
tttcctggttataaattc

SEQ ID NO: 943 - DNA, 19 bp, Artificial
  Antisense Oligonucleotides
atttcctggttataaattc

SEQ ID NO: 944 - DNA, 20 bp, Artificial
  Antisense Oligonucleotides
catttcctggttataaattc

SEQ ID NO: 945 - DNA, 19 bp, Artificial
  Antisense Oligonucleotides
catttcctggttataaatt

SEQ ID NO: 946 - DNA, 20 bp, Artificial
  Antisense Oligonucleotides
tcatttcctggttataaatt

SEQ ID NO: 947 - DNA, 18 bp, Artificial
  Antisense Oligonucleotides
catttcctggttataaat

SEQ ID NO: 948 - DNA, 19 bp, Artificial
  Antisense Oligonucleotides
tcatttcctggttataaat

SEQ ID NO: 949 - DNA, 17 bp, Artificial
  Antisense Oligonucleotides
cactgtctgtataccct

SEQ ID NO: 950 - DNA, 18 bp, Artificial
  Antisense Oligonucleotides
cactcactgtctgtatac

SEQ ID NO: 951 - DNA, 19 bp, Artificial
  Antisense Oligonucleotides
acactcactgtctgtatac

SEQ ID NO: 952 - DNA, 17 bp, Artificial
  Antisense Oligonucleotides
cactcactgtctgtata

SEQ ID NO: 953 - DNA, 17 bp, Artificial
  Antisense Oligonucleotides
agcttacactcactgtc

SEQ ID NO: 954 - DNA, 17 bp, Artificial
  Antisense Oligonucleotides
aagcttacactcactgt

SEQ ID NO: 955 - DNA, 16 bp, Artificial
  Antisense Oligonucleotides
ccaagcttacactcac

SEQ ID NO: 956 - DNA, 17 bp, Artificial
  Antisense Oligonucleotides
gcattactcaccttcag

SEQ ID NO: 957 - DNA, 19 bp, Artificial
  Antisense Oligonucleotides
tagagatgaaataagagag

SEQ ID NO: 958 - DNA, 19 bp, Artificial
  Antisense Oligonucleotides
taatgttaagggaaagaga

SEQ ID NO: 959 - DNA, 18 bp, Artificial
  Antisense Oligonucleotides
taagggtatcagtaggca

SEQ ID NO: 960 - DNA, 16 bp, Artificial
  Antisense Oligonucleotides
taagggtatcagtagg

SEQ ID NO: 961 - DNA, 19 bp, Artificial
  Antisense Oligonucleotides
gactggaaatatggattta

SEQ ID NO: 962 - DNA, 20 bp, Artificial
  Antisense Oligonucleotides
atatatgttcacttaaaagg

SEQ ID NO: 963 - DNA, 19 bp, Artificial
  Antisense Oligonucleotides
atatatgttcacttaaaag

SEQ ID NO: 964 - DNA, 20 bp, Artificial
  Antisense Oligonucleotides
atcatgggtataaaaggcac

SEQ ID NO: 965 - DNA, 19 bp, Artificial
  Antisense Oligonucleotides
tttaactttactatattgg

SEQ ID NO: 966 - DNA, 17 bp, Artificial
  Antisense Oligonucleotides
atgtacttttggttgac

SEQ ID NO: 967 - DNA, 18 bp, Artificial
  Antisense Oligonucleotides
atagtgatctttattctg

SEQ ID NO: 968 - DNA, 20 bp, Artificial
  Antisense Oligonucleotides
ttacaggcttttaattcatc

SEQ ID NO: 969 - DNA, 18 bp, Artificial
  Antisense Oligonucleotides
ctttacaggcttttaatt

SEQ ID NO: 970 - DNA, 20 bp, Artificial
  Antisense Oligonucleotides
attttattcttctttgtctc

SEQ ID NO: 971 - DNA, 18 bp, Artificial
  Antisense Oligonucleotides
ttcacaaatatccaacac

SEQ ID NO: 972 - DNA, 18 bp, Artificial
  Antisense Oligonucleotides
caattcacaaatatccaa

SEQ ID NO: 973 - DNA, 18 bp, Artificial
  Antisense Oligonucleotides
ccagattgttgttcatga

SEQ ID NO: 974 - DNA, 17 bp, Artificial
  Antisense Oligonucleotides
ttctgaataggggctaa

SEQ ID NO: 975 - DNA, 19 bp, Artificial
  Antisense Oligonucleotides
tattccattcctgtttatt

SEQ ID NO: 976 - DNA, 20 bp, Artificial
  Antisense Oligonucleotides
tatgtgctataagtttgcaa

SEQ ID NO: 977 - DNA, 17 bp, Artificial
  Antisense Oligonucleotides
tgtgtggaattaatgcc

SEQ ID NO: 978 - DNA, 18 bp, Artificial
  Antisense Oligonucleotides
tctgtcacttatcttttg

SEQ ID NO: 979 - DNA, 20 bp, Artificial
  Antisense Oligonucleotides
ttgggagataaaataactca

SEQ ID NO: 980 - DNA, 18 bp, Artificial
  Antisense Oligonucleotides
cttgggagataaaataac

SEQ ID NO: 981 - DNA, 18 bp, Artificial
  Antisense Oligonucleotides
caacaaccatttatagca

SEQ ID NO: 982 - DNA, 19 bp, Artificial
  Antisense Oligonucleotides
tcaacaaccatttatagca

SEQ ID NO: 983 - DNA, 18 bp, Artificial
  Antisense Oligonucleotides
tcaacaaccatttatagc

SEQ ID NO: 984 - DNA, 19 bp, Artificial
  Antisense Oligonucleotides
gtcaacaaccatttatagc

SEQ ID NO: 985 - DNA, 20 bp, Artificial
  Antisense Oligonucleotides
tgtcaacaaccatttatagc

SEQ ID NO: 986 - DNA, 18 bp, Artificial
  Antisense Oligonucleotides
gtcaacaaccatttatag

SEQ ID NO: 987 - DNA, 19 bp, Artificial
  Antisense Oligonucleotides
tgtcaacaaccatttatag

SEQ ID NO: 988 - DNA, 20 bp, Artificial
  Antisense Oligonucleotides
gtgtcaacaaccatttatag

SEQ ID NO: 989 - DNA, 18 bp, Artificial
  Antisense Oligonucleotides
tgtcaacaaccatttata

SEQ ID NO: 990 - DNA, 19 bp, Artificial
  Antisense Oligonucleotides
gtgtcaacaaccatttata

SEQ ID NO: 991 - DNA, 19 bp, Artificial
  Antisense Oligonucleotides
aggttggtttttaaataga

SEQ ID NO: 992 - DNA, 18 bp, Artificial
  Antisense Oligonucleotides
aggttggtttttaaatag

SEQ ID NO: 993 - DNA, 18 bp, Artificial
  Antisense Oligonucleotides
tttaatatttgtaacttg

SEQ ID NO: 994 - DNA, 18 bp, Artificial
  Antisense Oligonucleotides
atttgctactattccact

SEQ ID NO: 995 - DNA, 20 bp, Artificial
  Antisense Oligonucleotides
catttattctaattttcctg

SEQ ID NO: 996 - DNA, 17 bp, Artificial
  Antisense Oligonucleotides
gatgatgagtttaaggg

SEQ ID NO: 997 - DNA, 17 bp, Artificial
  Antisense Oligonucleotides
ttaggatgatgagttta

SEQ ID NO: 998 - DNA, 17 bp, Artificial
  Antisense Oligonucleotides
aaggcagggttatttga

SEQ ID NO: 999 - DNA, 20 bp, Artificial
  Antisense Oligonucleotides
ctaattctttcttcactttc

SEQ ID NO: 1000 - DNA, 17 bp, Artificial
  Antisense Oligonucleotides
atggttgattctaattc

SEQ ID NO: 1001 - DNA, 20 bp, Artificial
  Antisense Oligonucleotides
tcattttgtttatatgttaa

SEQ ID NO: 1002 - DNA, 18 bp, Artificial
  Antisense Oligonucleotides
gataaatatattgggtta

SEQ ID NO: 1003 - DNA, 17 bp, Artificial
  Antisense Oligonucleotides
tgattcagagcattact

SEQ ID NO: 1004 - DNA, 18 bp, Artificial
  Antisense Oligonucleotides
gtctttaagaatctgttt

SEQ ID NO: 1005 - DNA, 19 bp, Artificial
  Antisense Oligonucleotides
tgtctttaagaatctgttt

SEQ ID NO: 1006 - DNA, 20 bp, Artificial
  Antisense Oligonucleotides
ctgtctttaagaatctgttt

SEQ ID NO: 1007 - DNA, 18 bp, Artificial
  Antisense Oligonucleotides
tgtctttaagaatctgtt

SEQ ID NO: 1008 - DNA, 19 bp, Artificial
  Antisense Oligonucleotides
ctgtctttaagaatctgtt

SEQ ID NO: 1009 - DNA, 20 bp, Artificial
  Antisense Oligonucleotides
gctgtctttaagaatctgtt

SEQ ID NO: 1010 - DNA, 18 bp, Artificial
  Antisense Oligonucleotides
ctgtctttaagaatctgt

SEQ ID NO: 1011 - DNA, 19 bp, Artificial
  Antisense Oligonucleotides
gctgtctttaagaatctgt

SEQ ID NO: 1012 - DNA, 18 bp, Artificial
  Antisense Oligonucleotides
gctgtctttaagaatctg

SEQ ID NO: 1013 - DNA, 20 bp, Artificial
  Antisense Oligonucleotides
tcaatgtttccaaacaattt

SEQ ID NO: 1014 - DNA, 19 bp, Artificial
  Antisense Oligonucleotides
tcaatgtttccaaacaatt

SEQ ID NO: 1015 - DNA, 18 bp, Artificial
  Antisense Oligonucleotides
tcaatgtttccaaacaat

SEQ ID NO: 1016 - DNA, 19 bp, Artificial
  Antisense Oligonucleotides
ttaacttcaagagtttgga

SEQ ID NO: 1017 - DNA, 17 bp, Artificial
  Antisense Oligonucleotides
gttaacttcaagagttt

SEQ ID NO: 1018 - DNA, 18 bp, Artificial
  Antisense Oligonucleotides
ctacagacatttggcaaa

SEQ ID NO: 1019 - DNA, 17 bp, Artificial
  Antisense Oligonucleotides
attttacaggattaggg

SEQ ID NO: 1020 - DNA, 18 bp, Artificial
  Antisense Oligonucleotides
gctttatttagaaagaaa

SEQ ID NO: 1021 - DNA, 20 bp, Artificial
  Antisense Oligonucleotides
aggctttatttagaaagaaa

SEQ ID NO: 1022 - DNA, 19 bp, Artificial
  Antisense Oligonucleotides
aggctttatttagaaagaa

SEQ ID NO: 1023 - DNA, 20 bp, Artificial
  Antisense Oligonucleotides
caggctttatttagaaagaa

SEQ ID NO: 1024 - DNA, 18 bp, Artificial
  Antisense Oligonucleotides
aggctttatttagaaaga

SEQ ID NO: 1025 - DNA, 19 bp, Artificial
  Antisense Oligonucleotides
caggctttatttagaaaga

SEQ ID NO: 1026 - DNA, 20 bp, Artificial
  Antisense Oligonucleotides
tcaggctttatttagaaaga

SEQ ID NO: 1027 - DNA, 19 bp, Artificial
  Antisense Oligonucleotides
tcaggctttatttagaaag

SEQ ID NO: 1028 - DNA, 20 bp, Artificial
  Antisense Oligonucleotides
ctcaggctttatttagaaag

SEQ ID NO: 1029 - DNA, 19 bp, Artificial
  Antisense Oligonucleotides
ctcaggctttatttagaaa

SEQ ID NO: 1030 - DNA, 20 bp, Artificial
  Antisense Oligonucleotides
tctcaggctttatttagaaa

SEQ ID NO: 1031 - DNA, 18 bp, Artificial
  Antisense Oligonucleotides
ctcaggctttatttagaa

SEQ ID NO: 1032 - DNA, 19 bp, Artificial
  Antisense Oligonucleotides
tctcaggctttatttagaa

SEQ ID NO: 1033 - DNA, 20 bp, Artificial
  Antisense Oligonucleotides
ttctcaggctttatttagaa

SEQ ID NO: 1034 - DNA, 18 bp, Artificial
  Antisense Oligonucleotides
tctcaggctttatttaga

SEQ ID NO: 1035 - DNA, 19 bp, Artificial
  Antisense Oligonucleotides
ttctcaggctttatttaga

SEQ ID NO: 1036 - DNA, 20 bp, Artificial
  Antisense Oligonucleotides
attctcaggctttatttaga

SEQ ID NO: 1037 - DNA, 17 bp, Artificial
  Antisense Oligonucleotides
tctcaggctttatttag

SEQ ID NO: 1038 - DNA, 18 bp, Artificial
  Antisense Oligonucleotides
ttctcaggctttatttag

SEQ ID NO: 1039 - DNA, 19 bp, Artificial
  Antisense Oligonucleotides
attctcaggctttatttag

SEQ ID NO: 1040 - DNA, 20 bp, Artificial
  Antisense Oligonucleotides
aattctcaggctttatttag

SEQ ID NO: 1041 - DNA, 18 bp, Artificial
  Antisense Oligonucleotides
attctcaggctttattta

SEQ ID NO: 1042 - DNA, 19 bp, Artificial
  Antisense Oligonucleotides
aattctcaggctttattta

SEQ ID NO: 1043 - DNA, 20 bp, Artificial
  Antisense Oligonucleotides
aaattctcaggctttattta

SEQ ID NO: 1044 - DNA, 20 bp, Artificial
  Antisense Oligonucleotides
caaattctcaggctttattt

SEQ ID NO: 1045 - DNA, 18 bp, Artificial
  Antisense Oligonucleotides
aaattctcaggctttatt

SEQ ID NO: 1046 - DNA, 19 bp, Artificial
  Antisense Oligonucleotides
caaattctcaggctttatt

SEQ ID NO: 1047 - DNA, 17 bp, Artificial
  Antisense Oligonucleotides
ttgaacttctatggcta

SEQ ID NO: 1048 - DNA, 18 bp, Artificial
  Antisense Oligonucleotides
cttgaacttctatggcta

SEQ ID NO: 1049 - DNA, 19 bp, Artificial
  Antisense Oligonucleotides
ccttgaacttctatggcta

SEQ ID NO: 1050 - DNA, 17 bp, Artificial
  Antisense Oligonucleotides
cttgaacttctatggct

SEQ ID NO: 1051 - DNA, 17 bp, Artificial
  Antisense Oligonucleotides
ccttgaacttctatggc

SEQ ID NO: 1052 - DNA, 17 bp, Artificial
  Antisense Oligonucleotides
ctactcaccaaaccacg

SEQ ID NO: 1053 - DNA, 17 bp, Artificial
  Antisense Oligonucleotides
agtcaaattgttattag

SEQ ID NO: 1054 - DNA, 20 bp, Artificial
  Antisense Oligonucleotides
actaaggtgaaatatacaca

SEQ ID NO: 1055 - DNA, 18 bp, Artificial
  Antisense Oligonucleotides
tatgaaaattaatgagta

SEQ ID NO: 1056 - DNA, 17 bp, Artificial
  Antisense Oligonucleotides
agggagatgtggtgaat

SEQ ID NO: 1057 - DNA, 18 bp, Artificial
  Antisense Oligonucleotides
atattctttctgtgttaa

SEQ ID NO: 1058 - DNA, 19 bp, Artificial
  Antisense Oligonucleotides
tgttttactgtaatagaaa

SEQ ID NO: 1059 - DNA, 20 bp, Artificial
  Antisense Oligonucleotides
catcttctatacttctactg

SEQ ID NO: 1060 - DNA, 17 bp, Artificial
  Antisense Oligonucleotides
tgtctgatctgtatgtt

SEQ ID NO: 1061 - DNA, 20 bp, Artificial
  Antisense Oligonucleotides
gaagaagtgtttattatccc

SEQ ID NO: 1062 - DNA, 18 bp, Artificial
  Antisense Oligonucleotides
tatgtacttttatttgga

SEQ ID NO: 1063 - DNA, 19 bp, Artificial
  Antisense Oligonucleotides
taaaacatgcctttactcc

SEQ ID NO: 1064 - DNA, 18 bp, Artificial
  Antisense Oligonucleotides
tgggactataatggcaga

SEQ ID NO: 1065 - DNA, 19 bp, Artificial
  Antisense Oligonucleotides
attatctattatgttgttt

SEQ ID NO: 1066 - DNA, 19 bp, Artificial
  Antisense Oligonucleotides
tgaaaagtaaatatgggaa

SEQ ID NO: 1067 - DNA, 19 bp, Artificial
  Antisense Oligonucleotides
agaaaagagaattactgac

SEQ ID NO: 1068 - DNA, 19 bp, Artificial
  Antisense Oligonucleotides
gatttcaataacttagaat

SEQ ID NO: 1069 - DNA, 20 bp, Artificial
  Antisense Oligonucleotides
tttaataatgtatgatttca

SEQ ID NO: 1070 - DNA, 17 bp, Artificial
  Antisense Oligonucleotides
ttggtagttgtgaggta

SEQ ID NO: 1071 - DNA, 18 bp, Artificial
  Antisense Oligonucleotides
tcttttctattaccattc

SEQ ID NO: 1072 - DNA, 19 bp, Artificial
  Antisense Oligonucleotides
aactagatggggaaagaaa

SEQ ID NO: 1073 - DNA, 18 bp, Artificial
  Antisense Oligonucleotides
tgaaatgggaaactaaga

SEQ ID NO: 1074 - DNA, 19 bp, Artificial
  Antisense Oligonucleotides
atatgaaatgggaaactaa

SEQ ID NO: 1075 - DNA, 18 bp, Artificial
  Antisense Oligonucleotides
aattgcttaccacatgcc

SEQ ID NO: 1076 - DNA, 18 bp, Artificial
  Antisense Oligonucleotides
taattgcttaccacatgc

SEQ ID NO: 1077 - DNA, 19 bp, Artificial
  Antisense Oligonucleotides
ataattgcttaccacatgc

SEQ ID NO: 1078 - DNA, 20 bp, Artificial
  Antisense Oligonucleotides
tataattgcttaccacatgc

SEQ ID NO: 1079 - DNA, 17 bp, Artificial
  Antisense Oligonucleotides
taattgcttaccacatg

SEQ ID NO: 1080 - DNA, 18 bp, Artificial
  Antisense Oligonucleotides
ataattgcttaccacatg

SEQ ID NO: 1081 - DNA, 19 bp, Artificial
  Antisense Oligonucleotides
tataattgcttaccacatg

SEQ ID NO: 1082 - DNA, 20 bp, Artificial
  Antisense Oligonucleotides
atataattgcttaccacatg

SEQ ID NO: 1083 - DNA, 17 bp, Artificial
  Antisense Oligonucleotides
ataattgcttaccacat

SEQ ID NO: 1084 - DNA, 18 bp, Artificial
  Antisense Oligonucleotides
tataattgcttaccacat

SEQ ID NO: 1085 - DNA, 19 bp, Artificial
  Antisense Oligonucleotides
atataattgcttaccacat

SEQ ID NO: 1086 - DNA, 20 bp, Artificial
  Antisense Oligonucleotides
aatataattgcttaccacat

SEQ ID NO: 1087 - DNA, 17 bp, Artificial
  Antisense Oligonucleotides
tataattgcttaccaca

SEQ ID NO: 1088 - DNA, 18 bp, Artificial
  Antisense Oligonucleotides
atataattgcttaccaca

SEQ ID NO: 1089 - DNA, 19 bp, Artificial
  Antisense Oligonucleotides
aatataattgcttaccaca

SEQ ID NO: 1090 - DNA, 20 bp, Artificial
  Antisense Oligonucleotides
aaatataattgcttaccaca

SEQ ID NO: 1091 - DNA, 17 bp, Artificial
  Antisense Oligonucleotides
atataattgcttaccac

SEQ ID NO: 1092 - DNA, 18 bp, Artificial
  Antisense Oligonucleotides
aatataattgcttaccac

SEQ ID NO: 1093 - DNA, 19 bp, Artificial
  Antisense Oligonucleotides
aaatataattgcttaccac

SEQ ID NO: 1094 - DNA, 20 bp, Artificial
  Antisense Oligonucleotides
aaaatataattgcttaccac

SEQ ID NO: 1095 - DNA, 18 bp, Artificial
  Antisense Oligonucleotides
aaatataattgcttacca

SEQ ID NO: 1096 - DNA, 20 bp, Artificial
  Antisense Oligonucleotides
caaaatataattgcttacca

SEQ ID NO: 1097 - DNA, 19 bp, Artificial
  Antisense Oligonucleotides
caaaatataattgcttacc

SEQ ID NO: 1098 - DNA, 17 bp, Artificial
  Antisense Oligonucleotides
tttggtaggatggaggc

SEQ ID NO: 1099 - DNA, 19 bp, Artificial
  Antisense Oligonucleotides
gatgttcaacttgtatttt

SEQ ID NO: 1100 - DNA, 19 bp, Artificial
  Antisense Oligonucleotides
tcagattttgtagtattta

SEQ ID NO: 1101 - DNA, 20 bp, Artificial
  Antisense Oligonucleotides
ttttccaatatttactagtt

SEQ ID NO: 1102 - DNA, 19 bp, Artificial
  Antisense Oligonucleotides
attattttccaatatttac

SEQ ID NO: 1103 - DNA, 17 bp, Artificial
  Antisense Oligonucleotides
aagtagtgatgatgaat

SEQ ID NO: 1104 - DNA, 20 bp, Artificial
  Antisense Oligonucleotides
tagatttgaacaaagatatt

SEQ ID NO: 1105 - DNA, 18 bp, Artificial
  Antisense Oligonucleotides
tagatttgaacaaagata

SEQ ID NO: 1106 - DNA, 17 bp, Artificial
  Antisense Oligonucleotides
ataggaaggaaactagg

SEQ ID NO: 1107 - DNA, 17 bp, Artificial
  Antisense Oligonucleotides
gaatttggtattcaggt

SEQ ID NO: 1108 - DNA, 20 bp, Artificial
  Antisense Oligonucleotides
catttatggggtataatatg

SEQ ID NO: 1109 - DNA, 18 bp, Artificial
  Antisense Oligonucleotides
tgatatttgttctattgt

SEQ ID NO: 1110 - DNA, 19 bp, Artificial
  Antisense Oligonucleotides
tttattttgatatttgttc

SEQ ID NO: 1111 - DNA, 20 bp, Artificial
  Antisense Oligonucleotides
atagtgtgttttgtgagtct

SEQ ID NO: 1112 - DNA, 17 bp, Artificial
  Antisense Oligonucleotides
aaaggttagatatatga

SEQ ID NO: 1113 - DNA, 18 bp, Artificial
  Antisense Oligonucleotides
tataagtttctaaggagt

SEQ ID NO: 1114 - DNA, 19 bp, Artificial
  Antisense Oligonucleotides
gatatataataaaatggta

SEQ ID NO: 1115 - DNA, 18 bp, Artificial
  Antisense Oligonucleotides
tttgttttctgagtagtg

SEQ ID NO: 1116 - DNA, 19 bp, Artificial
  Antisense Oligonucleotides
attaatgtttattatttgc

SEQ ID NO: 1117 - DNA, 18 bp, Artificial
  Antisense Oligonucleotides
agaaaagtagcaagacaa

SEQ ID NO: 1118 - DNA, 17 bp, Artificial
  Antisense Oligonucleotides
tgaactgaagactgttg

SEQ ID NO: 1119 - DNA, 20 bp, Artificial
  Antisense Oligonucleotides
gtagagaaatttaagacagt

SEQ ID NO: 1120 - DNA, 19 bp, Artificial
  Antisense Oligonucleotides
agtaaatgtagagaaattt

SEQ ID NO: 1121 - DNA, 20 bp, Artificial
  Antisense Oligonucleotides
taagtgaacagttttgtagt

SEQ ID NO: 1122 - DNA, 19 bp, Artificial
  Antisense Oligonucleotides
tttaagtgaacagttttgt

SEQ ID NO: 1123 - DNA, 20 bp, Artificial
  Antisense Oligonucleotides
cacatgacattaaattgtac

SEQ ID NO: 1124 - DNA, 18 bp, Artificial
  Antisense Oligonucleotides
acacatgacattaaattg

SEQ ID NO: 1125 - DNA, 17 bp, Artificial
  Antisense Oligonucleotides
gtatttggtgtggtggg

SEQ ID NO: 1126 - DNA, 17 bp, Artificial
  Antisense Oligonucleotides
gatggtatttggtgtgg

SEQ ID NO: 1127 - DNA, 19 bp, Artificial
  Antisense Oligonucleotides
aggagagatgaagaaggaa

SEQ ID NO: 1128 - DNA, 20 bp, Artificial
  Antisense Oligonucleotides
agtattctctccattttatg

SEQ ID NO: 1129 - DNA, 18 bp, Artificial
  Antisense Oligonucleotides
gagaggataaataggaaa

SEQ ID NO: 1130 - DNA, 17 bp, Artificial
  Antisense Oligonucleotides
cctgcatctgttaatat

SEQ ID NO: 1131 - DNA, 20 bp, Artificial
  Antisense Oligonucleotides
attatttatttattttcctc

SEQ ID NO: 1132 - DNA, 19 bp, Artificial
  Antisense Oligonucleotides
gtgttgtctaactgagaga

SEQ ID NO: 1133 - DNA, 19 bp, Artificial
  Antisense Oligonucleotides
ttttctttatctatgaact

SEQ ID NO: 1134 - DNA, 18 bp, Artificial
  Antisense Oligonucleotides
cctgatgtgaaattgtca

SEQ ID NO: 1135 - DNA, 20 bp, Artificial
  Antisense Oligonucleotides
gtaatagtgatagtttccat

SEQ ID NO: 1136 - DNA, 19 bp, Artificial
  Antisense Oligonucleotides
atgaaaatgatgatagtaa

SEQ ID NO: 1137 - DNA, 18 bp, Artificial
  Antisense Oligonucleotides
gtttaatcatcttagaat

SEQ ID NO: 1138 - DNA, 19 bp, Artificial
  Antisense Oligonucleotides
tttgttgagtgatggtgtc

SEQ ID NO: 1139 - DNA, 19 bp, Artificial
  Antisense Oligonucleotides
attgtaggaaaacttcaga

SEQ ID NO: 1140 - DNA, 20 bp, Artificial
  Antisense Oligonucleotides
atagagaatgacacctggag

SEQ ID NO: 1141 - DNA, 19 bp, Artificial
  Antisense Oligonucleotides
atagagaatgacacctgga

SEQ ID NO: 1142 - DNA, 20 bp, Artificial
  Antisense Oligonucleotides
tatagagaatgacacctgga

SEQ ID NO: 1143 - DNA, 20 bp, Artificial
  Antisense Oligonucleotides
atatagagaatgacacctgg

SEQ ID NO: 1144 - DNA, 19 bp, Artificial
  Antisense Oligonucleotides
atatagagaatgacacctg

SEQ ID NO: 1145 - DNA, 20 bp, Artificial
  Antisense Oligonucleotides
aatatagagaatgacacctg

SEQ ID NO: 1146 - DNA, 18 bp, Artificial
  Antisense Oligonucleotides
atatagagaatgacacct

SEQ ID NO: 1147 - DNA, 19 bp, Artificial
  Antisense Oligonucleotides
aatatagagaatgacacct

SEQ ID NO: 1148 - DNA, 20 bp, Artificial
  Antisense Oligonucleotides
gaatatagagaatgacacct

SEQ ID NO: 1149 - DNA, 17 bp, Artificial
  Antisense Oligonucleotides
atatagagaatgacacc

SEQ ID NO: 1150 - DNA, 18 bp, Artificial
  Antisense Oligonucleotides
aatatagagaatgacacc

SEQ ID NO: 1151 - DNA, 19 bp, Artificial
  Antisense Oligonucleotides
gaatatagagaatgacacc

SEQ ID NO: 1152 - DNA, 20 bp, Artificial
  Antisense Oligonucleotides
agaatatagagaatgacacc

SEQ ID NO: 1153 - DNA, 18 bp, Artificial
  Antisense Oligonucleotides
gaatatagagaatgacac

SEQ ID NO: 1154 - DNA, 20 bp, Artificial
  Antisense Oligonucleotides
tagaatatagagaatgacac

SEQ ID NO: 1155 - DNA, 18 bp, Artificial
  Antisense Oligonucleotides
gtagaatatagagaatga

SEQ ID NO: 1156 - DNA, 17 bp, Artificial
  Antisense Oligonucleotides
acatcataagctccagc

SEQ ID NO: 1157 - DNA, 18 bp, Artificial
  Antisense Oligonucleotides
tacatcataagctccagc

SEQ ID NO: 1158 - DNA, 19 bp, Artificial
  Antisense Oligonucleotides
atacatcataagctccagc

SEQ ID NO: 1159 - DNA, 18 bp, Artificial
  Antisense Oligonucleotides
atacatcataagctccag

SEQ ID NO: 1160 - DNA, 19 bp, Artificial
  Antisense Oligonucleotides
catacatcataagctccag

SEQ ID NO: 1161 - DNA, 20 bp, Artificial
  Antisense Oligonucleotides
acatacatcataagctccag

SEQ ID NO: 1162 - DNA, 17 bp, Artificial
  Antisense Oligonucleotides
atacatcataagctcca

SEQ ID NO: 1163 - DNA, 18 bp, Artificial
  Antisense Oligonucleotides
catacatcataagctcca

SEQ ID NO: 1164 - DNA, 19 bp, Artificial
  Antisense Oligonucleotides
acatacatcataagctcca

SEQ ID NO: 1165 - DNA, 20 bp, Artificial
  Antisense Oligonucleotides
tacatacatcataagctcca

SEQ ID NO: 1166 - DNA, 17 bp, Artificial
  Antisense Oligonucleotides
catacatcataagctcc

SEQ ID NO: 1167 - DNA, 18 bp, Artificial
  Antisense Oligonucleotides
acatacatcataagctcc

SEQ ID NO: 1168 - DNA, 19 bp, Artificial
  Antisense Oligonucleotides
tacatacatcataagctcc

SEQ ID NO: 1169 - DNA, 20 bp, Artificial
  Antisense Oligonucleotides
ttacatacatcataagctcc

SEQ ID NO: 1170 - DNA, 17 bp, Artificial
  Antisense Oligonucleotides
acatacatcataagctc

SEQ ID NO: 1171 - DNA, 18 bp, Artificial
  Antisense Oligonucleotides
tacatacatcataagctc

SEQ ID NO: 1172 - DNA, 19 bp, Artificial
  Antisense Oligonucleotides
ttacatacatcataagctc

SEQ ID NO: 1173 - DNA, 20 bp, Artificial
  Antisense Oligonucleotides
attacatacatcataagctc

SEQ ID NO: 1174 - DNA, 18 bp, Artificial
  Antisense Oligonucleotides
ttacatacatcataagct

SEQ ID NO: 1175 - DNA, 19 bp, Artificial
  Antisense Oligonucleotides
attacatacatcataagct

SEQ ID NO: 1176 - DNA, 20 bp, Artificial
  Antisense Oligonucleotides
tattacatacatcataagct

SEQ ID NO: 1177 - DNA, 17 bp, Artificial
  Antisense Oligonucleotides
ttacatacatcataagc

SEQ ID NO: 1178 - DNA, 18 bp, Artificial
  Antisense Oligonucleotides
attacatacatcataagc

SEQ ID NO: 1179 - DNA, 19 bp, Artificial
  Antisense Oligonucleotides
tattacatacatcataagc

SEQ ID NO: 1180 - DNA, 20 bp, Artificial
  Antisense Oligonucleotides
ttattacatacatcataagc

SEQ ID NO: 1181 - DNA, 18 bp, Artificial
  Antisense Oligonucleotides
tattacatacatcataag

SEQ ID NO: 1182 - DNA, 19 bp, Artificial
  Antisense Oligonucleotides
ttattacatacatcataag

SEQ ID NO: 1183 - DNA, 20 bp, Artificial
  Antisense Oligonucleotides
gttattacatacatcataag

SEQ ID NO: 1184 - DNA, 19 bp, Artificial
  Antisense Oligonucleotides
gttattacatacatcataa

SEQ ID NO: 1185 - DNA, 20 bp, Artificial
  Antisense Oligonucleotides
agttattacatacatcataa

SEQ ID NO: 1186 - DNA, 18 bp, Artificial
  Antisense Oligonucleotides
gttattacatacatcata

SEQ ID NO: 1187 - DNA, 19 bp, Artificial
  Antisense Oligonucleotides
agttattacatacatcata

SEQ ID NO: 1188 - DNA, 20 bp, Artificial
  Antisense Oligonucleotides
tagttattacatacatcata

SEQ ID NO: 1189 - DNA, 19 bp, Artificial
  Antisense Oligonucleotides
tagttattacatacatcat

SEQ ID NO: 1190 - DNA, 20 bp, Artificial
  Antisense Oligonucleotides
atagttattacatacatcat

SEQ ID NO: 1191 - DNA, 18 bp, Artificial
  Antisense Oligonucleotides
tagttattacatacatca

SEQ ID NO: 1192 - DNA, 19 bp, Artificial
  Antisense Oligonucleotides
atagttattacatacatca

SEQ ID NO: 1193 - DNA, 20 bp, Artificial
  Antisense Oligonucleotides
aatagttattacatacatca

SEQ ID NO: 1194 - DNA, 18 bp, Artificial
  Antisense Oligonucleotides
atagttattacatacatc

SEQ ID NO: 1195 - DNA, 19 bp, Artificial
  Antisense Oligonucleotides
aatagttattacatacatc

SEQ ID NO: 1196 - DNA, 20 bp, Artificial
  Antisense Oligonucleotides
aaatagttattacatacatc

SEQ ID NO: 1197 - DNA, 19 bp, Artificial
  Antisense Oligonucleotides
taaatagttattacataca

SEQ ID NO: 1198 - DNA, 20 bp, Artificial
  Antisense Oligonucleotides
ataaatagttattacataca

SEQ ID NO: 1199 - DNA, 20 bp, Artificial
  Antisense Oligonucleotides
tataatataaaattatgtga

SEQ ID NO: 1200 - DNA, 18 bp, Artificial
  Antisense Oligonucleotides
gattctgaacttaattta

SEQ ID NO: 1201 - DNA, 19 bp, Artificial
  Antisense Oligonucleotides
aagatggtgaatgtgctag

SEQ ID NO: 1202 - DNA, 18 bp, Artificial
  Antisense Oligonucleotides
ttttaattcctgaagctt

SEQ ID NO: 1203 - DNA, 19 bp, Artificial
  Antisense Oligonucleotides
caaaatgaggtattatata

SEQ ID NO: 1204 - DNA, 19 bp, Artificial
  Antisense Oligonucleotides
gagtatctgataagggacc

SEQ ID NO: 1205 - DNA, 20 bp, Artificial
  Antisense Oligonucleotides
attaaagagtatctgataag

SEQ ID NO: 1206 - DNA, 20 bp, Artificial
  Antisense Oligonucleotides
gtgatggaaacttcaaaaat

SEQ ID NO: 1207 - DNA, 17 bp, Artificial
  Antisense Oligonucleotides
ttgatgaggtctttggc

SEQ ID NO: 1208 - DNA, 18 bp, Artificial
  Antisense Oligonucleotides
attgatgaggtctttggc

SEQ ID NO: 1209 - DNA, 17 bp, Artificial
  Antisense Oligonucleotides
acttacacagatccatg

SEQ ID NO: 1210 - DNA, 18 bp, Artificial
  Antisense Oligonucleotides
tacttacacagatccatg

SEQ ID NO: 1211 - DNA, 19 bp, Artificial
  Antisense Oligonucleotides
ttacttacacagatccatg

SEQ ID NO: 1212 - DNA, 20 bp, Artificial
  Antisense Oligonucleotides
tttacttacacagatccatg

SEQ ID NO: 1213 - DNA, 17 bp, Artificial
  Antisense Oligonucleotides
tacttacacagatccat

SEQ ID NO: 1214 - DNA, 18 bp, Artificial
  Antisense Oligonucleotides
ttacttacacagatccat

SEQ ID NO: 1215 - DNA, 19 bp, Artificial
  Antisense Oligonucleotides
tttacttacacagatccat

SEQ ID NO: 1216 - DNA, 20 bp, Artificial
  Antisense Oligonucleotides
ttttacttacacagatccat

SEQ ID NO: 1217 - DNA, 17 bp, Artificial
  Antisense Oligonucleotides
ttacttacacagatcca

SEQ ID NO: 1218 - DNA, 18 bp, Artificial
  Antisense Oligonucleotides
tttacttacacagatcca

SEQ ID NO: 1219 - DNA, 19 bp, Artificial
  Antisense Oligonucleotides
ttttacttacacagatcca

SEQ ID NO: 1220 - DNA, 20 bp, Artificial
  Antisense Oligonucleotides
gttttacttacacagatcca

SEQ ID NO: 1221 - DNA, 17 bp, Artificial
  Antisense Oligonucleotides
tttacttacacagatcc

SEQ ID NO: 1222 - DNA, 18 bp, Artificial
  Antisense Oligonucleotides
ttttacttacacagatcc

SEQ ID NO: 1223 - DNA, 19 bp, Artificial
  Antisense Oligonucleotides
gttttacttacacagatcc

SEQ ID NO: 1224 - DNA, 20 bp, Artificial
  Antisense Oligonucleotides
agttttacttacacagatcc

SEQ ID NO: 1225 - DNA, 18 bp, Artificial
  Antisense Oligonucleotides
gttttacttacacagatc

SEQ ID NO: 1226 - DNA, 19 bp, Artificial
  Antisense Oligonucleotides
agttttacttacacagatc

SEQ ID NO: 1227 - DNA, 20 bp, Artificial
  Antisense Oligonucleotides
aagttttacttacacagatc

SEQ ID NO: 1228 - DNA, 18 bp, Artificial
  Antisense Oligonucleotides
agttttacttacacagat

SEQ ID NO: 1229 - DNA, 19 bp, Artificial
  Antisense Oligonucleotides
aagttttacttacacagat

SEQ ID NO: 1230 - DNA, 20 bp, Artificial
  Antisense Oligonucleotides
gaagttttacttacacagat

SEQ ID NO: 1231 - DNA, 20 bp, Artificial
  Antisense Oligonucleotides
agaagttttacttacacaga

SEQ ID NO: 1232 - DNA, 19 bp, Artificial
  Antisense Oligonucleotides
agaagttttacttacacag

SEQ ID NO: 1233 - DNA, 20 bp, Artificial
  Antisense Oligonucleotides
gagaagttttacttacacag

SEQ ID NO: 1234 - DNA, 19 bp, Artificial
  Antisense Oligonucleotides
gagaagttttacttacaca

SEQ ID NO: 1235 - DNA, 18 bp, Artificial
  Antisense Oligonucleotides
gagaagttttacttacac

SEQ ID NO: 1236 - DNA, 18 bp, Artificial
  Antisense Oligonucleotides
aaatcttttcttctggga

SEQ ID NO: 1237 - DNA, 17 bp, Artificial
  Antisense Oligonucleotides
gcctttcatttacttag

SEQ ID NO: 1238 - DNA, 20 bp, Artificial
  Antisense Oligonucleotides
aattatctttattttaatgt

SEQ ID NO: 1239 - DNA, 18 bp, Artificial
  Antisense Oligonucleotides
ttctaagtattcaattgc

SEQ ID NO: 1240 - DNA, 16 bp, Artificial
  Antisense Oligonucleotides
acagtagaacgttgct

SEQ ID NO: 1241 - DNA, 17 bp, Artificial
  Antisense Oligonucleotides
aacagtagaacgttgct

SEQ ID NO: 1242 - DNA, 16 bp, Artificial
  Antisense Oligonucleotides
aacagtagaacgttgc

SEQ ID NO: 1243 - DNA, 17 bp, Artificial
  Antisense Oligonucleotides
caacagtagaacgttgc

SEQ ID NO: 1244 - DNA, 16 bp, Artificial
  Antisense Oligonucleotides
caacagtagaacgttg

SEQ ID NO: 1245 - DNA, 17 bp, Artificial
  Antisense Oligonucleotides
gcaacagtagaacgttg

SEQ ID NO: 1246 - DNA, 18 bp, Artificial
  Antisense Oligonucleotides
caagcagtctacagtctc

SEQ ID NO: 1247 - DNA, 17 bp, Artificial
  Antisense Oligonucleotides
tcaagcagtctacagtc

SEQ ID NO: 1248 - DNA, 18 bp, Artificial
  Antisense Oligonucleotides
ttcaagcagtctacagtc

SEQ ID NO: 1249 - DNA, 17 bp, Artificial
  Antisense Oligonucleotides
ttcaagcagtctacagt

SEQ ID NO: 1250 - DNA, 18 bp, Artificial
  Antisense Oligonucleotides
cttcaagcagtctacagt

SEQ ID NO: 1251 - DNA, 18 bp, Artificial
  Antisense Oligonucleotides
tcttcaagcagtctacag

SEQ ID NO: 1252 - DNA, 20 bp, Artificial
  Antisense Oligonucleotides
tttcttcaagcagtctacag

SEQ ID NO: 1253 - DNA, 17 bp, Artificial
  Antisense Oligonucleotides
tcttcaagcagtctaca

SEQ ID NO: 1254 - DNA, 18 bp, Artificial
  Antisense Oligonucleotides
ttcttcaagcagtctaca

SEQ ID NO: 1255 - DNA, 19 bp, Artificial
  Antisense Oligonucleotides
tttcttcaagcagtctaca

SEQ ID NO: 1256 - DNA, 20 bp, Artificial
  Antisense Oligonucleotides
atttcttcaagcagtctaca

SEQ ID NO: 1257 - DNA, 19 bp, Artificial
  Antisense Oligonucleotides
atttcttcaagcagtctac

SEQ ID NO: 1258 - DNA, 20 bp, Artificial
  Antisense Oligonucleotides
aatttcttcaagcagtctac

SEQ ID NO: 1259 - DNA, 19 bp, Artificial
  Antisense Oligonucleotides
aatttcttcaagcagtcta

SEQ ID NO: 1260 - DNA, 18 bp, Artificial
  Antisense Oligonucleotides
aaatttcttcaagcagtc

SEQ ID NO: 1261 - DNA, 19 bp, Artificial
  Antisense Oligonucleotides
taaatttcttcaagcagtc

SEQ ID NO: 1262 - DNA, 20 bp, Artificial
  Antisense Oligonucleotides
ttaaatttcttcaagcagtc

SEQ ID NO: 1263 - DNA, 18 bp, Artificial
  Antisense Oligonucleotides
taaatttcttcaagcagt

SEQ ID NO: 1264 - DNA, 19 bp, Artificial
  Antisense Oligonucleotides
ttaaatttcttcaagcagt

SEQ ID NO: 1265 - DNA, 20 bp, Artificial
  Antisense Oligonucleotides
attaaatttcttcaagcagt

SEQ ID NO: 1266 - DNA, 18 bp, Artificial
  Antisense Oligonucleotides
ttaaatttcttcaagcag

SEQ ID NO: 1267 - DNA, 19 bp, Artificial
  Antisense Oligonucleotides
attaaatttcttcaagcag

SEQ ID NO: 1268 - DNA, 20 bp, Artificial
  Antisense Oligonucleotides
cattaaatttcttcaagcag

SEQ ID NO: 1269 - DNA, 18 bp, Artificial
  Antisense Oligonucleotides
attaaatttcttcaagca

SEQ ID NO: 1270 - DNA, 19 bp, Artificial
  Antisense Oligonucleotides
cattaaatttcttcaagca

SEQ ID NO: 1271 - DNA, 20 bp, Artificial
  Antisense Oligonucleotides
gcattaaatttcttcaagca

SEQ ID NO: 1272 - DNA, 18 bp, Artificial
  Antisense Oligonucleotides
cattaaatttcttcaagc

SEQ ID NO: 1273 - DNA, 19 bp, Artificial
  Antisense Oligonucleotides
gcattaaatttcttcaagc

SEQ ID NO: 1274 - DNA, 20 bp, Artificial
  Antisense Oligonucleotides
agcattaaatttcttcaagc

SEQ ID NO: 1275 - DNA, 18 bp, Artificial
  Antisense Oligonucleotides
gcattaaatttcttcaag

SEQ ID NO: 1276 - DNA, 19 bp, Artificial
  Antisense Oligonucleotides
agcattaaatttcttcaag

SEQ ID NO: 1277 - DNA, 18 bp, Artificial
  Antisense Oligonucleotides
agcattaaatttcttcaa

SEQ ID NO: 1278 - DNA, 20 bp, Artificial
  Antisense Oligonucleotides
ctttagttttcttctagcat

SEQ ID NO: 1279 - DNA, 19 bp, Artificial
  Antisense Oligonucleotides
ctttagttttcttctagca

SEQ ID NO: 1280 - DNA, 18 bp, Artificial
  Antisense Oligonucleotides
ctttagttttcttctagc

SEQ ID NO: 1281 - DNA, 18 bp, Artificial
  Antisense Oligonucleotides
cctttagttttcttctag

SEQ ID NO: 1282 - DNA, 18 bp, Artificial
  Antisense Oligonucleotides
acctttagttttcttcta

SEQ ID NO: 1283 - DNA, 18 bp, Artificial
  Antisense Oligonucleotides
ttacctttagttttcttc

SEQ ID NO: 1284 - DNA, 18 bp, Artificial
  Antisense Oligonucleotides
cttacctttagttttctt

SEQ ID NO: 1285 - DNA, 20 bp, Artificial
  Antisense Oligonucleotides
taaaatttcttacctttagt

SEQ ID NO: 1286 - DNA, 19 bp, Artificial
  Antisense Oligonucleotides
taaaatttcttacctttag

SEQ ID NO: 1287 - DNA, 20 bp, Artificial
  Antisense Oligonucleotides
gtaaaatttcttacctttag

SEQ ID NO: 1288 - DNA, 19 bp, Artificial
  Antisense Oligonucleotides
gtaaaatttcttaccttta

SEQ ID NO: 1289 - DNA, 20 bp, Artificial
  Antisense Oligonucleotides
tgtaaaatttcttaccttta

SEQ ID NO: 1290 - DNA, 19 bp, Artificial
  Antisense Oligonucleotides
tgtaaaatttcttaccttt

SEQ ID NO: 1291 - DNA, 20 bp, Artificial
  Antisense Oligonucleotides
atgtaaaatttcttaccttt

SEQ ID NO: 1292 - DNA, 19 bp, Artificial
  Antisense Oligonucleotides
atgtaaaatttcttacctt

SEQ ID NO: 1293 - DNA, 20 bp, Artificial
  Antisense Oligonucleotides
aatgtaaaatttcttacctt

SEQ ID NO: 1294 - DNA, 19 bp, Artificial
  Antisense Oligonucleotides
aatgtaaaatttcttacct

SEQ ID NO: 1295 - DNA, 20 bp, Artificial
  Antisense Oligonucleotides
aaatgtaaaatttcttacct

SEQ ID NO: 1296 - DNA, 18 bp, Artificial
  Antisense Oligonucleotides
aatgtaaaatttcttacc

SEQ ID NO: 1297 - DNA, 19 bp, Artificial
  Antisense Oligonucleotides
aaatgtaaaatttcttacc

SEQ ID NO: 1298 - DNA, 18 bp, Artificial
  Antisense Oligonucleotides
acataattgaaagccttt

SEQ ID NO: 1299 - DNA, 20 bp, Artificial
  Antisense Oligonucleotides
ccctgtgaaaaaaattagaa

SEQ ID NO: 1300 - DNA, 20 bp, Artificial
  Antisense Oligonucleotides
accctgtgaaaaaaattaga

SEQ ID NO: 1301 - DNA, 18 bp, Artificial
  Antisense Oligonucleotides
ccctgtgaaaaaaattag

SEQ ID NO: 1302 - DNA, 19 bp, Artificial
  Antisense Oligonucleotides
accctgtgaaaaaaattag

SEQ ID NO: 1303 - DNA, 20 bp, Artificial
  Antisense Oligonucleotides
caccctgtgaaaaaaattag

SEQ ID NO: 1304 - DNA, 18 bp, Artificial
  Antisense Oligonucleotides
accctgtgaaaaaaatta

SEQ ID NO: 1305 - DNA, 19 bp, Artificial
  Antisense Oligonucleotides
caccctgtgaaaaaaatta

SEQ ID NO: 1306 - DNA, 18 bp, Artificial
  Antisense Oligonucleotides
caccctgtgaaaaaaatt

SEQ ID NO: 1307 - DNA, 18 bp, Artificial
  Antisense Oligonucleotides
gcaccctgtgaaaaaaat

SEQ ID NO: 1308 - DNA, 17 bp, Artificial
  Antisense Oligonucleotides
gcatagttgtcaagatg

SEQ ID NO: 1309 - DNA, 18 bp, Artificial
  Antisense Oligonucleotides
agcatagttgtcaagatg

SEQ ID NO: 1310 - DNA, 19 bp, Artificial
  Antisense Oligonucleotides
cagcatagttgtcaagatg

SEQ ID NO: 1311 - DNA, 17 bp, Artificial
  Antisense Oligonucleotides
agcatagttgtcaagat

SEQ ID NO: 1312 - DNA, 18 bp, Artificial
  Antisense Oligonucleotides
cagcatagttgtcaagat

SEQ ID NO: 1313 - DNA, 17 bp, Artificial
  Antisense Oligonucleotides
cagcatagttgtcaaga

SEQ ID NO: 1314 - DNA, 18 bp, Artificial
  Antisense Oligonucleotides
catggaatcattttgagg

SEQ ID NO: 1315 - DNA, 17 bp, Artificial
  Antisense Oligonucleotides
attggttgaagagcatt

SEQ ID NO: 1316 - DNA, 18 bp, Artificial
  Antisense Oligonucleotides
gtttatgaaacaggtaac

SEQ ID NO: 1317 - DNA, 18 bp, Artificial
  Antisense Oligonucleotides
ttttagtttacatgatga

SEQ ID NO: 1318 - DNA, 19 bp, Artificial
  Antisense Oligonucleotides
atgattcagggtaagcagg

SEQ ID NO: 1319 - DNA, 20 bp, Artificial
  Antisense Oligonucleotides
ttattattaattgagattgt

SEQ ID NO: 1320 - DNA, 19 bp, Artificial
  Antisense Oligonucleotides
taatttattattaattgag

SEQ ID NO: 1321 - DNA, 18 bp, Artificial
  Antisense Oligonucleotides
tgttactaaacttcttga

SEQ ID NO: 1322 - DNA, 18 bp, Artificial
  Antisense Oligonucleotides
cagacaatttggttttac

SEQ ID NO: 1323 - DNA, 18 bp, Artificial
  Antisense Oligonucleotides
aaaggatactggaacttt

SEQ ID NO: 1324 - DNA, 20 bp, Artificial
  Antisense Oligonucleotides
gaaaaggatactggaacttt

SEQ ID NO: 1325 - DNA, 19 bp, Artificial
  Antisense Oligonucleotides
gaaaaggatactggaactt

SEQ ID NO: 1326 - DNA, 17 bp, Artificial
  Antisense Oligonucleotides
cagttgtgtttattgga

SEQ ID NO: 1327 - DNA, 18 bp, Artificial
  Antisense Oligonucleotides
agcaaatttagaactaaa

SEQ ID NO: 1328 - DNA, 19 bp, Artificial
  Antisense Oligonucleotides
cagcaaatttagaactaaa

SEQ ID NO: 1329 - DNA, 18 bp, Artificial
  Antisense Oligonucleotides
cagcaaatttagaactaa

SEQ ID NO: 1330 - DNA, 19 bp, Artificial
  Antisense Oligonucleotides
gctgctgtaaaatgagagt

SEQ ID NO: 1331 - DNA, 18 bp, Artificial
  Antisense Oligonucleotides
gctgctgtaaaatgagag

SEQ ID NO: 1332 - DNA, 19 bp, Artificial
  Antisense Oligonucleotides
taacttacctttactccat

SEQ ID NO: 1333 - DNA, 18 bp, Artificial
  Antisense Oligonucleotides
taacttacctttactcca

SEQ ID NO: 1334 - DNA, 19 bp, Artificial
  Antisense Oligonucleotides
ttaacttacctttactcca

SEQ ID NO: 1335 - DNA, 20 bp, Artificial
  Antisense Oligonucleotides
tttaacttacctttactcca

SEQ ID NO: 1336 - DNA, 18 bp, Artificial
  Antisense Oligonucleotides
ttaacttacctttactcc

SEQ ID NO: 1337 - DNA, 19 bp, Artificial
  Antisense Oligonucleotides
tttaacttacctttactcc

SEQ ID NO: 1338 - DNA, 17 bp, Artificial
  Antisense Oligonucleotides
ttaacttacctttactc

SEQ ID NO: 1339 - DNA, 18 bp, Artificial
  Antisense Oligonucleotides
gtttaacttacctttact

SEQ ID NO: 1340 - DNA, 17 bp, Artificial
  Antisense Oligonucleotides
gtttaacttacctttac

SEQ ID NO: 1341 - DNA, 18 bp, Artificial
  Antisense Oligonucleotides
tgtttaacttacctttac

SEQ ID NO: 1342 - DNA, 19 bp, Artificial
  Antisense Oligonucleotides
ctgtttaacttacctttac

SEQ ID NO: 1343 - DNA, 20 bp, Artificial
  Antisense Oligonucleotides
tctgtttaacttacctttac

SEQ ID NO: 1344 - DNA, 18 bp, Artificial
  Antisense Oligonucleotides
ctgtttaacttaccttta

SEQ ID NO: 1345 - DNA, 19 bp, Artificial
  Antisense Oligonucleotides
tctgtttaacttaccttta

SEQ ID NO: 1346 - DNA, 20 bp, Artificial
  Antisense Oligonucleotides
atctgtttaacttaccttta

SEQ ID NO: 1347 - DNA, 19 bp, Artificial
  Antisense Oligonucleotides
atctgtttaacttaccttt

SEQ ID NO: 1348 - DNA, 20 bp, Artificial
  Antisense Oligonucleotides
catctgtttaacttaccttt

SEQ ID NO: 1349 - DNA, 18 bp, Artificial
  Antisense Oligonucleotides
atctgtttaacttacctt

SEQ ID NO: 1350 - DNA, 19 bp, Artificial
  Antisense Oligonucleotides
catctgtttaacttacctt

SEQ ID NO: 1351 - DNA, 17 bp, Artificial
  Antisense Oligonucleotides
atctgtttaacttacct

SEQ ID NO: 1352 - DNA, 18 bp, Artificial
  Antisense Oligonucleotides
catctgtttaacttacct

SEQ ID NO: 1353 - DNA, 17 bp, Artificial
  Antisense Oligonucleotides
catctgtttaacttacc

SEQ ID NO: 1354 - DNA, 18 bp, Artificial
  Antisense Oligonucleotides
gcatctgtttaacttacc

SEQ ID NO: 1355 - DNA, 20 bp, Artificial
  Antisense Oligonucleotides
taacatttaaagattatcca

SEQ ID NO: 1356 - DNA, 20 bp, Artificial
  Antisense Oligonucleotides
ttatttggaaaagcatttgg

SEQ ID NO: 1357 - DNA, 19 bp, Artificial
  Antisense Oligonucleotides
tattattttgtttagaaag

SEQ ID NO: 1358 - DNA, 18 bp, Artificial
  Antisense Oligonucleotides
gtgttgatgaagaatgta

SEQ ID NO: 1359 - DNA, 18 bp, Artificial
  Antisense Oligonucleotides
attaattaattcccaaga

SEQ ID NO: 1360 - DNA, 17 bp, Artificial
  Antisense Oligonucleotides
tataagttgaatggaag

SEQ ID NO: 1361 - DNA, 17 bp, Artificial
  Antisense Oligonucleotides
ttctgaattgaccagtc

SEQ ID NO: 1362 - DNA, 18 bp, Artificial
  Antisense Oligonucleotides
tttctgaattgaccagtc

SEQ ID NO: 1363 - DNA, 18 bp, Artificial
  Antisense Oligonucleotides
cttttctgaattgaccag

SEQ ID NO: 1364 - DNA, 18 bp, Artificial
  Antisense Oligonucleotides
ccttttctgaattgacca

SEQ ID NO: 1365 - DNA, 18 bp, Artificial
  Antisense Oligonucleotides
tccttttctgaattgacc

SEQ ID NO: 1366 - DNA, 19 bp, Artificial
  Antisense Oligonucleotides
ttccttttctgaattgacc

SEQ ID NO: 1367 - DNA, 17 bp, Artificial
  Antisense Oligonucleotides
catctgaacactcgaac

SEQ ID NO: 1368 - DNA, 18 bp, Artificial
  Antisense Oligonucleotides
tcatctgaacactcgaac

SEQ ID NO: 1369 - DNA, 19 bp, Artificial
  Antisense Oligonucleotides
atcatctgaacactcgaac

SEQ ID NO: 1370 - DNA, 20 bp, Artificial
  Antisense Oligonucleotides
catcatctgaacactcgaac

SEQ ID NO: 1371 - DNA, 16 bp, Artificial
  Antisense Oligonucleotides
atcatctgaacactcg

SEQ ID NO: 1372 - DNA, 17 bp, Artificial
  Antisense Oligonucleotides
catcatctgaacactcg

SEQ ID NO: 1373 - DNA, 19 bp, Artificial
  Antisense Oligonucleotides
caaattcaatttcagagaa

SEQ ID NO: 1374 - DNA, 20 bp, Artificial
  Antisense Oligonucleotides
aggtgttaaatttattgttt

SEQ ID NO: 1375 - DNA, 19 bp, Artificial
  Antisense Oligonucleotides
gtgtgatataattatttta

SEQ ID NO: 1376 - DNA, 20 bp, Artificial
  Antisense Oligonucleotides
ttaaatgaatatgtgcctca

SEQ ID NO: 1377 - DNA, 18 bp, Artificial
  Antisense Oligonucleotides
ttctttattgttaggtat

SEQ ID NO: 1378 - DNA, 20 bp, Artificial
  Antisense Oligonucleotides
tatttaatatgctatattta

SEQ ID NO: 1379 - DNA, 18 bp, Artificial
  Antisense Oligonucleotides
agaatttaacatgatatt

SEQ ID NO: 1380 - DNA, 18 bp, Artificial
  Antisense Oligonucleotides
tagtattgagaggaagat

SEQ ID NO: 1381 - DNA, 20 bp, Artificial
  Antisense Oligonucleotides
tatttattattttctaaagg

SEQ ID NO: 1382 - DNA, 19 bp, Artificial
  Antisense Oligonucleotides
taaagaatatatcattacc

SEQ ID NO: 1383 - DNA, 17 bp, Artificial
  Antisense Oligonucleotides
ttcaattattagtgggg

SEQ ID NO: 1384 - DNA, 19 bp, Artificial
  Antisense Oligonucleotides
gatgaacgtgaaagacatg

SEQ ID NO: 1385 - DNA, 20 bp, Artificial
  Antisense Oligonucleotides
tgcagaaaatagaaacagag

SEQ ID NO: 1386 - DNA, 20 bp, Artificial
  Antisense Oligonucleotides
atgcagaaaatagaaacaga

SEQ ID NO: 1387 - DNA, 18 bp, Artificial
  Antisense Oligonucleotides
tttgttgtttatctgtgg

SEQ ID NO: 1388 - DNA, 19 bp, Artificial
  Antisense Oligonucleotides
ctttgttgtttatctgtgg

SEQ ID NO: 1389 - DNA, 18 bp, Artificial
  Antisense Oligonucleotides
ctttgttgtttatctgtg

SEQ ID NO: 1390 - DNA, 18 bp, Artificial
  Antisense Oligonucleotides
gctttgttgtttatctgt

SEQ ID NO: 1391 - DNA, 19 bp, Artificial
  Antisense Oligonucleotides
tggctttgttgtttatctg

SEQ ID NO: 1392 - DNA, 19 bp, Artificial
  Antisense Oligonucleotides
ttggctttgttgtttatct

SEQ ID NO: 1393 - DNA, 17 bp, Artificial
  Antisense Oligonucleotides
tggctttgttgtttatc

SEQ ID NO: 1394 - DNA, 18 bp, Artificial
  Antisense Oligonucleotides
ttggctttgttgtttatc

SEQ ID NO: 1395 - DNA, 18 bp, Artificial
  Antisense Oligonucleotides
gttggctttgttgtttat

SEQ ID NO: 1396 - DNA, 19 bp, Artificial
  Antisense Oligonucleotides
cgttggctttgttgtttat

SEQ ID NO: 1397 - DNA, 20 bp, Artificial
  Antisense Oligonucleotides
acgttggctttgttgtttat

SEQ ID NO: 1398 - DNA, 18 bp, Artificial
  Antisense Oligonucleotides
cgttggctttgttgttta

SEQ ID NO: 1399 - DNA, 19 bp, Artificial
  Antisense Oligonucleotides
acgttggctttgttgttta

SEQ ID NO: 1400 - DNA, 18 bp, Artificial
  Antisense Oligonucleotides
tattttctttggggctgg

SEQ ID NO: 1401 - DNA, 18 bp, Artificial
  Antisense Oligonucleotides
atattttctttggggctg

SEQ ID NO: 1402 - DNA, 17 bp, Artificial
  Antisense Oligonucleotides
atattttctttggggct

SEQ ID NO: 1403 - DNA, 18 bp, Artificial
  Antisense Oligonucleotides
aatattttctttggggct

SEQ ID NO: 1404 - DNA, 18 bp, Artificial
  Antisense Oligonucleotides
aggaatattttctttggg

SEQ ID NO: 1405 - DNA, 18 bp, Artificial
  Antisense Oligonucleotides
gtaaagaacttaagaagg

SEQ ID NO: 1406 - DNA, 20 bp, Artificial
  Antisense Oligonucleotides
gtgttttaataagagggaaa

SEQ ID NO: 1407 - DNA, 18 bp, Artificial
  Antisense Oligonucleotides
attgtgtggatttgattg

SEQ ID NO: 1408 - DNA, 18 bp, Artificial
  Antisense Oligonucleotides
gttaattgtgtggatttg

SEQ ID NO: 1409 - DNA, 20 bp, Artificial
  Antisense Oligonucleotides
taatcactataatttgaggc

SEQ ID NO: 1410 - DNA, 18 bp, Artificial
  Antisense Oligonucleotides
gttatattggtttgaaac

SEQ ID NO: 1411 - DNA, 18 bp, Artificial
  Antisense Oligonucleotides
aaaagaccttattcttga

SEQ ID NO: 1412 - DNA, 19 bp, Artificial
  Antisense Oligonucleotides
caaaagaccttattcttga

SEQ ID NO: 1413 - DNA, 20 bp, Artificial
  Antisense Oligonucleotides
gcaaaagaccttattcttga

SEQ ID NO: 1414 - DNA, 18 bp, Artificial
  Antisense Oligonucleotides
caaaagaccttattcttg

SEQ ID NO: 1415 - DNA, 19 bp, Artificial
  Antisense Oligonucleotides
gcaaaagaccttattcttg

SEQ ID NO: 1416 - DNA, 20 bp, Artificial
  Antisense Oligonucleotides
tgcaaaagaccttattcttg

SEQ ID NO: 1417 - DNA, 18 bp, Artificial
  Antisense Oligonucleotides
gcaaaagaccttattctt

SEQ ID NO: 1418 - DNA, 19 bp, Artificial
  Antisense Oligonucleotides
tgcaaaagaccttattctt

SEQ ID NO: 1419 - DNA, 20 bp, Artificial
  Antisense Oligonucleotides
atgcaaaagaccttattctt

SEQ ID NO: 1420 - DNA, 17 bp, Artificial
  Antisense Oligonucleotides
gcaaaagaccttattct

SEQ ID NO: 1421 - DNA, 18 bp, Artificial
  Antisense Oligonucleotides
tgcaaaagaccttattct

SEQ ID NO: 1422 - DNA, 18 bp, Artificial
  Antisense Oligonucleotides
atgcaaaagaccttattc

SEQ ID NO: 1423 - DNA, 19 bp, Artificial
  Antisense Oligonucleotides
atgaaatagtgacaagagc

SEQ ID NO: 1424 - DNA, 17 bp, Artificial
  Antisense Oligonucleotides
ttacagtagtttggggc

SEQ ID NO: 1425 - DNA, 18 bp, Artificial
  Antisense Oligonucleotides
attacagtagtttggggc

SEQ ID NO: 1426 - DNA, 17 bp, Artificial
  Antisense Oligonucleotides
attacagtagtttgggg

SEQ ID NO: 1427 - DNA, 17 bp, Artificial
  Antisense Oligonucleotides
cagggttgtggattaca

SEQ ID NO: 1428 - DNA, 18 bp, Artificial
  Antisense Oligonucleotides
tcagggttgtggattaca

SEQ ID NO: 1429 - DNA, 17 bp, Artificial
  Antisense Oligonucleotides
tcagggttgtggattac

SEQ ID NO: 1430 - DNA, 16 bp, Artificial
  Antisense Oligonucleotides
tcagggttgtggatta

SEQ ID NO: 1431 - DNA, 18 bp, Artificial
  Antisense Oligonucleotides
tctgaataccttgtttcc

SEQ ID NO: 1432 - DNA, 17 bp, Artificial
  Antisense Oligonucleotides
gtggtagaaaatggtta

SEQ ID NO: 1433 - DNA, 18 bp, Artificial
  Antisense Oligonucleotides
actcaaaagtaacactaa

SEQ ID NO: 1434 - DNA, 18 bp, Artificial
  Antisense Oligonucleotides
aattggacacatggaata

SEQ ID NO: 1435 - DNA, 17 bp, Artificial
  Antisense Oligonucleotides
ttaatgtgacctagtat

SEQ ID NO: 1436 - DNA, 20 bp, Artificial
  Antisense Oligonucleotides
attttagagattcagtattc

SEQ ID NO: 1437 - DNA, 18 bp, Artificial
  Antisense Oligonucleotides
tcagtaatggaaaacaga

SEQ ID NO: 1438 - DNA, 19 bp, Artificial
  Antisense Oligonucleotides
tggaattataatgaataat

SEQ ID NO: 1439 - DNA, 17 bp, Artificial
  Antisense Oligonucleotides
tgtagaagcagcggaag

SEQ ID NO: 1440 - DNA, 18 bp, Artificial
  Antisense Oligonucleotides
gtgatttgtagaagcagc

SEQ ID NO: 1441 - DNA, 20 bp, Artificial
  Antisense Oligonucleotides
cctgatgagaagaaaacaca

SEQ ID NO: 1442 - DNA, 19 bp, Artificial
  Antisense Oligonucleotides
cctgatgagaagaaaacac

SEQ ID NO: 1443 - DNA, 20 bp, Artificial
  Antisense Oligonucleotides
tcctgatgagaagaaaacac

SEQ ID NO: 1444 - DNA, 18 bp, Artificial
  Antisense Oligonucleotides
cctgatgagaagaaaaca

SEQ ID NO: 1445 - DNA, 19 bp, Artificial
  Antisense Oligonucleotides
tcctgatgagaagaaaaca

SEQ ID NO: 1446 - DNA, 18 bp, Artificial
  Antisense Oligonucleotides
tcctgatgagaagaaaac

SEQ ID NO: 1447 - DNA, 19 bp, Artificial
  Antisense Oligonucleotides
atacctttcacatcttcat

SEQ ID NO: 1448 - DNA, 20 bp, Artificial
  Antisense Oligonucleotides
catacctttcacatcttcat

SEQ ID NO: 1449 - DNA, 18 bp, Artificial
  Antisense Oligonucleotides
atacctttcacatcttca

SEQ ID NO: 1450 - DNA, 19 bp, Artificial
  Antisense Oligonucleotides
catacctttcacatcttca

SEQ ID NO: 1451 - DNA, 17 bp, Artificial
  Antisense Oligonucleotides
atacctttcacatcttc

SEQ ID NO: 1452 - DNA, 18 bp, Artificial
  Antisense Oligonucleotides
catacctttcacatcttc

SEQ ID NO: 1453 - DNA, 19 bp, Artificial
  Antisense Oligonucleotides
tcatacctttcacatcttc

SEQ ID NO: 1454 - DNA, 20 bp, Artificial
  Antisense Oligonucleotides
atcatacctttcacatcttc

SEQ ID NO: 1455 - DNA, 18 bp, Artificial
  Antisense Oligonucleotides
tcatacctttcacatctt

SEQ ID NO: 1456 - DNA, 19 bp, Artificial
  Antisense Oligonucleotides
atcatacctttcacatctt

SEQ ID NO: 1457 - DNA, 20 bp, Artificial
  Antisense Oligonucleotides
aatcatacctttcacatctt

SEQ ID NO: 1458 - DNA, 18 bp, Artificial
  Antisense Oligonucleotides
atcatacctttcacatct

SEQ ID NO: 1459 - DNA, 19 bp, Artificial
  Antisense Oligonucleotides
aatcatacctttcacatct

SEQ ID NO: 1460 - DNA, 20 bp, Artificial
  Antisense Oligonucleotides
aaatcatacctttcacatct

SEQ ID NO: 1461 - DNA, 17 bp, Artificial
  Antisense Oligonucleotides
atcatacctttcacatc

SEQ ID NO: 1462 - DNA, 18 bp, Artificial
  Antisense Oligonucleotides
aatcatacctttcacatc

SEQ ID NO: 1463 - DNA, 19 bp, Artificial
  Antisense Oligonucleotides
aaatcatacctttcacatc

SEQ ID NO: 1464 - DNA, 20 bp, Artificial
  Antisense Oligonucleotides
taaatcatacctttcacatc

SEQ ID NO: 1465 - DNA, 19 bp, Artificial
  Antisense Oligonucleotides
taaatcatacctttcacat

SEQ ID NO: 1466 - DNA, 20 bp, Artificial
  Antisense Oligonucleotides
ttaaatcatacctttcacat

SEQ ID NO: 1467 - DNA, 18 bp, Artificial
  Antisense Oligonucleotides
taaatcatacctttcaca

SEQ ID NO: 1468 - DNA, 19 bp, Artificial
  Antisense Oligonucleotides
ttaaatcatacctttcaca

SEQ ID NO: 1469 - DNA, 20 bp, Artificial
  Antisense Oligonucleotides
gttaaatcatacctttcaca

SEQ ID NO: 1470 - DNA, 17 bp, Artificial
  Antisense Oligonucleotides
taaatcatacctttcac

SEQ ID NO: 1471 - DNA, 18 bp, Artificial
  Antisense Oligonucleotides
ttaaatcatacctttcac

SEQ ID NO: 1472 - DNA, 19 bp, Artificial
  Antisense Oligonucleotides
gttaaatcatacctttcac

SEQ ID NO: 1473 - DNA, 18 bp, Artificial
  Antisense Oligonucleotides
gttaaatcatacctttca

SEQ ID NO: 1474 - DNA, 17 bp, Artificial
  Antisense Oligonucleotides
gttaaatcatacctttc

SEQ ID NO: 1475 - DNA, 18 bp, Artificial
  Antisense Oligonucleotides
tcattattagttgtcatt

SEQ ID NO: 1476 - DNA, 17 bp, Artificial
  Antisense Oligonucleotides
ttgagatgactaaaagt

SEQ ID NO: 1477 - DNA, 17 bp, Artificial
  Antisense Oligonucleotides
cagatgaggtttaatta

SEQ ID NO: 1478 - DNA, 20 bp, Artificial
  Antisense Oligonucleotides
aataaaattcttgacacagc

SEQ ID NO: 1479 - DNA, 20 bp, Artificial
  Antisense Oligonucleotides
tatttaaagattcagtttct

SEQ ID NO: 1480 - DNA, 17 bp, Artificial
  Antisense Oligonucleotides
tgaattggagaactgtt

SEQ ID NO: 1481 - DNA, 18 bp, Artificial
  Antisense Oligonucleotides
tcaatattaaaagggtta

SEQ ID NO: 1482 - DNA, 17 bp, Artificial
  Antisense Oligonucleotides
cttggatgttagttata

SEQ ID NO: 1483 - DNA, 18 bp, Artificial
  Antisense Oligonucleotides
tgcagaagtatgtatggg

SEQ ID NO: 1484 - DNA, 20 bp, Artificial
  Antisense Oligonucleotides
atctctgactacttttgctt

SEQ ID NO: 1485 - DNA, 17 bp, Artificial
  Antisense Oligonucleotides
attcatataaagggtag

SEQ ID NO: 1486 - DNA, 19 bp, Artificial
  Antisense Oligonucleotides
caagattcatataaagggt

SEQ ID NO: 1487 - DNA, 17 bp, Artificial
  Antisense Oligonucleotides
aaaatgtggttagagct

SEQ ID NO: 1488 - DNA, 18 bp, Artificial
  Antisense Oligonucleotides
gtgagatactggaaacag

SEQ ID NO: 1489 - DNA, 19 bp, Artificial
  Antisense Oligonucleotides
agtgagatactggaaacag

SEQ ID NO: 1490 - DNA, 18 bp, Artificial
  Antisense Oligonucleotides
gagctgaagtgagatact

SEQ ID NO: 1491 - DNA, 18 bp, Artificial
  Antisense Oligonucleotides
atgaaactgtgttacatt

SEQ ID NO: 1492 - DNA, 18 bp, Artificial
  Antisense Oligonucleotides
aatgaaactgtgttacat

SEQ ID NO: 1493 - DNA, 18 bp, Artificial
  Antisense Oligonucleotides
aagaaaagctatttatag

SEQ ID NO: 1494 - DNA, 17 bp, Artificial
  Antisense Oligonucleotides
cgataatggaacagtag

SEQ ID NO: 1495 - DNA, 20 bp, Artificial
  Antisense Oligonucleotides
ataaagtaaattatatttgg

SEQ ID NO: 1496 - DNA, 19 bp, Artificial
  Antisense Oligonucleotides
ctgctgttatgaggaaacc

SEQ ID NO: 1497 - DNA, 19 bp, Artificial
  Antisense Oligonucleotides
gttttataataatatgtat

SEQ ID NO: 1498 - DNA, 20 bp, Artificial
  Antisense Oligonucleotides
aatattaatttaattttaga

SEQ ID NO: 1499 - DNA, 20 bp, Artificial
  Antisense Oligonucleotides
tattaaaattgcacaggatt

SEQ ID NO: 1500 - DNA, 20 bp, Artificial
  Antisense Oligonucleotides
tcatctttcttttctaaatc

SEQ ID NO: 1501 - DNA, 20 bp, Artificial
  Antisense Oligonucleotides
attataatcttttcttacct

SEQ ID NO: 1502 - DNA, 19 bp, Artificial
  Antisense Oligonucleotides
attataatcttttcttacc

SEQ ID NO: 1503 - DNA, 18 bp, Artificial
  Antisense Oligonucleotides
cattggtgaagagatatg

SEQ ID NO: 1504 - DNA, 20 bp, Artificial
  Antisense Oligonucleotides
cttggtacattatcttgcag

SEQ ID NO: 1505 - DNA, 20 bp, Artificial
  Antisense Oligonucleotides
tacttgtcctttatcattag

SEQ ID NO: 1506 - DNA, 17 bp, Artificial
  Antisense Oligonucleotides
tgtaaggtaaagtcttt

SEQ ID NO: 1507 - DNA, 20 bp, Artificial
  Antisense Oligonucleotides
gtaagattagactgtgctac

SEQ ID NO: 1508 - DNA, 20 bp, Artificial
  Antisense Oligonucleotides
attgtatttcttgattttac

SEQ ID NO: 1509 - DNA, 17 bp, Artificial
  Antisense Oligonucleotides
ccaggaatagctttaaa

SEQ ID NO: 1510 - DNA, 18 bp, Artificial
  Antisense Oligonucleotides
atctgaattttgtgttag

SEQ ID NO: 1511 - DNA, 20 bp, Artificial
  Antisense Oligonucleotides
tattatttcttgttttagcc

SEQ ID NO: 1512 - DNA, 19 bp, Artificial
  Antisense Oligonucleotides
acatattatttcttgtttt

SEQ ID NO: 1513 - DNA, 20 bp, Artificial
  Antisense Oligonucleotides
tttaaatgaatgaatccaag

SEQ ID NO: 1514 - DNA, 19 bp, Artificial
  Antisense Oligonucleotides
ttttaaatgaatgaatcca

SEQ ID NO: 1515 - DNA, 17 bp, Artificial
  Antisense Oligonucleotides
gataatatagctttggc

SEQ ID NO: 1516 - DNA, 20 bp, Artificial
  Antisense Oligonucleotides
ttcagttttcttagatgcat

SEQ ID NO: 1517 - DNA, 17 bp, Artificial
  Antisense Oligonucleotides
aatggagttggtgagca

SEQ ID NO: 1518 - DNA, 17 bp, Artificial
  Antisense Oligonucleotides
gataacatttggtcaga

SEQ ID NO: 1519 - DNA, 17 bp, Artificial
  Antisense Oligonucleotides
tctggagggatgtaatt

SEQ ID NO: 1520 - DNA, 19 bp, Artificial
  Antisense Oligonucleotides
tctaccaattaaatattta

SEQ ID NO: 1521 - DNA, 18 bp, Artificial
  Antisense Oligonucleotides
tcctctaccaattaaata

SEQ ID NO: 1522 - DNA, 18 bp, Artificial
  Antisense Oligonucleotides
ctatgatatgaatgtatg

SEQ ID NO: 1523 - DNA, 17 bp, Artificial
  Antisense Oligonucleotides
tgacttaatgctatgat

SEQ ID NO: 1524 - DNA, 19 bp, Artificial
  Antisense Oligonucleotides
gttattattattttcaggt

SEQ ID NO: 1525 - DNA, 20 bp, Artificial
  Antisense Oligonucleotides
tatgtagtttgggtatttat

SEQ ID NO: 1526 - DNA, 17 bp, Artificial
  Antisense Oligonucleotides
ctttatgtagtttgggt

SEQ ID NO: 1527 - DNA, 20 bp, Artificial
  Antisense Oligonucleotides
ttaaattcacattttacttt

SEQ ID NO: 1528 - DNA, 19 bp, Artificial
  Antisense Oligonucleotides
ctccataacatttaccatc

SEQ ID NO: 1529 - DNA, 18 bp, Artificial
  Antisense Oligonucleotides
attctctccataacattt

SEQ ID NO: 1530 - DNA, 18 bp, Artificial
  Antisense Oligonucleotides
tgttagttttattctcag

SEQ ID NO: 1531 - DNA, 19 bp, Artificial
  Antisense Oligonucleotides
gacaatagtaagaatttta

SEQ ID NO: 1532 - DNA, 20 bp, Artificial
  Antisense Oligonucleotides
taaaggtgttcttagtttaa

SEQ ID NO: 1533 - DNA, 18 bp, Artificial
  Antisense Oligonucleotides
tcttgttgaaatattggg

SEQ ID NO: 1534 - DNA, 18 bp, Artificial
  Antisense Oligonucleotides
ttcttgttgaaatattgg

SEQ ID NO: 1535 - DNA, 18 bp, Artificial
  Antisense Oligonucleotides
ttgcaagacttatttagg

SEQ ID NO: 1536 - DNA, 18 bp, Artificial
  Antisense Oligonucleotides
tatgttgcattcatctat

SEQ ID NO: 1537 - DNA, 18 bp, Artificial
  Antisense Oligonucleotides
gccaatttacaaaacata

SEQ ID NO: 1538 - DNA, 17 bp, Artificial
  Antisense Oligonucleotides
gctctcagtcatatttc

SEQ ID NO: 1539 - DNA, 20 bp, Artificial
  Antisense Oligonucleotides
gtaggttttaatttctttca

SEQ ID NO: 1540 - DNA, 18 bp, Artificial
  Antisense Oligonucleotides
gagttaatttcaaagtgt

SEQ ID NO: 1541 - DNA, 20 bp, Artificial
  Antisense Oligonucleotides
tgctaatcaattttatatta

SEQ ID NO: 1542 - DNA, 19 bp, Artificial
  Antisense Oligonucleotides
tctgctaatcaattttata

SEQ ID NO: 1543 - DNA, 20 bp, Artificial
  Antisense Oligonucleotides
ttaagagttgatgacatgga

SEQ ID NO: 1544 - DNA, 20 bp, Artificial
  Antisense Oligonucleotides
gtatttataaagattttcat

SEQ ID NO: 1545 - DNA, 17 bp, Artificial
  Antisense Oligonucleotides
gatcatttagaataagt

SEQ ID NO: 1546 - DNA, 18 bp, Artificial
  Antisense Oligonucleotides
taatgttggggagaggaa

SEQ ID NO: 1547 - DNA, 18 bp, Artificial
  Antisense Oligonucleotides
actgactacttaattact

SEQ ID NO: 1548 - DNA, 17 bp, Artificial
  Antisense Oligonucleotides
aatatgtctagttctat

SEQ ID NO: 1549 - DNA, 18 bp, Artificial
  Antisense Oligonucleotides
ttttcagttgtttagatt

SEQ ID NO: 1550 - DNA, 18 bp, Artificial
  Antisense Oligonucleotides
tggttagacaatatatat

SEQ ID NO: 1551 - DNA, 18 bp, Artificial
  Antisense Oligonucleotides
tctttgataactgtactt

SEQ ID NO: 1552 - DNA, 20 bp, Artificial
  Antisense Oligonucleotides
atttctaactgcattctaaa

SEQ ID NO: 1553 - DNA, 18 bp, Artificial
  Antisense Oligonucleotides
tatttctaactgcattct

SEQ ID NO: 1554 - DNA, 20 bp, Artificial
  Antisense Oligonucleotides
tggaaataatttaagtataa

SEQ ID NO: 1555 - DNA, 18 bp, Artificial
  Antisense Oligonucleotides
atggcatataggaaatgt

SEQ ID NO: 1556 - DNA, 17 bp, Artificial
  Antisense Oligonucleotides
tgaactcttctaaaacc

SEQ ID NO: 1557 - DNA, 19 bp, Artificial
  Antisense Oligonucleotides
ctctcttgcttttctacat

SEQ ID NO: 1558 - DNA, 18 bp, Artificial
  Antisense Oligonucleotides
cttggtttaacagataaa

SEQ ID NO: 1559 - DNA, 20 bp, Artificial
  Antisense Oligonucleotides
gatttggttactataacaat

SEQ ID NO: 1560 - DNA, 17 bp, Artificial
  Antisense Oligonucleotides
tggaagagtaagataag

SEQ ID NO: 1561 - DNA, 17 bp, Artificial
  Antisense Oligonucleotides
tatagtagtcagcttgt

SEQ ID NO: 1562 - DNA, 18 bp, Artificial
  Antisense Oligonucleotides
tgaatcatttgtatatag

SEQ ID NO: 1563 - DNA, 17 bp, Artificial
  Antisense Oligonucleotides
agtttatagagtgtgaa

SEQ ID NO: 1564 - DNA, 17 bp, Artificial
  Antisense Oligonucleotides
cagttaggcaataggtg

SEQ ID NO: 1565 - DNA, 16 bp, Artificial
  Antisense Oligonucleotides
ttacttcatcgagact

SEQ ID NO: 1566 - DNA, 17 bp, Artificial
  Antisense Oligonucleotides
attttacttcatcgaga

SEQ ID NO: 1567 - DNA, 19 bp, Artificial
  Antisense Oligonucleotides
tttattttcttgtatagcc

SEQ ID NO: 1568 - DNA, 19 bp, Artificial
  Antisense Oligonucleotides
agaagtgacatatgaatca

SEQ ID NO: 1569 - DNA, 20 bp, Artificial
  Antisense Oligonucleotides
tattgaactttatataatta

SEQ ID NO: 1570 - DNA, 18 bp, Artificial
  Antisense Oligonucleotides
tcttgctttcgtgctaaa

SEQ ID NO: 1571 - DNA, 17 bp, Artificial
  Antisense Oligonucleotides
tcttgctttcgtgctaa

SEQ ID NO: 1572 - DNA, 18 bp, Artificial
  Antisense Oligonucleotides
ctcttgctttcgtgctaa

SEQ ID NO: 1573 - DNA, 19 bp, Artificial
  Antisense Oligonucleotides
taatctcttgctttcgtgc

SEQ ID NO: 1574 - DNA, 20 bp, Artificial
  Antisense Oligonucleotides
ataatctcttgctttcgtgc

SEQ ID NO: 1575 - DNA, 19 bp, Artificial
  Antisense Oligonucleotides
ataatctcttgctttcgtg

SEQ ID NO: 1576 - DNA, 20 bp, Artificial
  Antisense Oligonucleotides
gataatctcttgctttcgtg

SEQ ID NO: 1577 - DNA, 19 bp, Artificial
  Antisense Oligonucleotides
aaaacatttcttaagctga

SEQ ID NO: 1578 - DNA, 20 bp, Artificial
  Antisense Oligonucleotides
gaaaacatttcttaagctga

SEQ ID NO: 1579 - DNA, 19 bp, Artificial
  Antisense Oligonucleotides
tacaaacatataaaagaga

SEQ ID NO: 1580 - DNA, 18 bp, Artificial
  Antisense Oligonucleotides
cttttcaatcatattcac

SEQ ID NO: 1581 - DNA, 19 bp, Artificial
  Antisense Oligonucleotides
aattatagtattacagtaa

SEQ ID NO: 1582 - DNA, 18 bp, Artificial
  Antisense Oligonucleotides
tgcttcagtatatatctt

SEQ ID NO: 1583 - DNA, 19 bp, Artificial
  Antisense Oligonucleotides
caaagatattagtgaactg

SEQ ID NO: 1584 - DNA, 17 bp, Artificial
  Antisense Oligonucleotides
taggcaaagatattagt

SEQ ID NO: 1585 - DNA, 20 bp, Artificial
  Antisense Oligonucleotides
tcctctataaatatggtttt

SEQ ID NO: 1586 - DNA, 19 bp, Artificial
  Antisense Oligonucleotides
gcttaaaatcaaatatata

SEQ ID NO: 1587 - DNA, 17 bp, Artificial
  Antisense Oligonucleotides
aaggtagatcaaatgga

SEQ ID NO: 1588 - DNA, 18 bp, Artificial
  Antisense Oligonucleotides
aaggtttaagagaggaag

SEQ ID NO: 1589 - DNA, 19 bp, Artificial
  Antisense Oligonucleotides
tattgtgtttaagtttatt

SEQ ID NO: 1590 - DNA, 19 bp, Artificial
  Antisense Oligonucleotides
tattattgtgtttaagttt

SEQ ID NO: 1591 - DNA, 20 bp, Artificial
  Antisense Oligonucleotides
ttttgttgtttcatgtgtaa

SEQ ID NO: 1592 - DNA, 19 bp, Artificial
  Antisense Oligonucleotides
agatttttctgtaaaagaa

SEQ ID NO: 1593 - DNA, 19 bp, Artificial
  Antisense Oligonucleotides
gaataaatgtaccattttc

SEQ ID NO: 1594 - DNA, 20 bp, Artificial
  Antisense Oligonucleotides
aggaataaatgtaccatttt

SEQ ID NO: 1595 - DNA, 19 bp, Artificial
  Antisense Oligonucleotides
aggaataaatgtaccattt

SEQ ID NO: 1596 - DNA, 20 bp, Artificial
  Antisense Oligonucleotides
taggaataaatgtaccattt

SEQ ID NO: 1597 - DNA, 18 bp, Artificial
  Antisense Oligonucleotides
aggaataaatgtaccatt

SEQ ID NO: 1598 - DNA, 19 bp, Artificial
  Antisense Oligonucleotides
taggaataaatgtaccatt

SEQ ID NO: 1599 - DNA, 20 bp, Artificial
  Antisense Oligonucleotides
ttaggaataaatgtaccatt

SEQ ID NO: 1600 - DNA, 18 bp, Artificial
  Antisense Oligonucleotides
taggaataaatgtaccat

SEQ ID NO: 1601 - DNA, 19 bp, Artificial
  Antisense Oligonucleotides
ttaggaataaatgtaccat

SEQ ID NO: 1602 - DNA, 20 bp, Artificial
  Antisense Oligonucleotides
attaggaataaatgtaccat

SEQ ID NO: 1603 - DNA, 18 bp, Artificial
  Antisense Oligonucleotides
ttaggaataaatgtacca

SEQ ID NO: 1604 - DNA, 19 bp, Artificial
  Antisense Oligonucleotides
attaggaataaatgtacca

SEQ ID NO: 1605 - DNA, 20 bp, Artificial
  Antisense Oligonucleotides
aattaggaataaatgtacca

SEQ ID NO: 1606 - DNA, 18 bp, Artificial
  Antisense Oligonucleotides
attaggaataaatgtacc

SEQ ID NO: 1607 - DNA, 19 bp, Artificial
  Antisense Oligonucleotides
aattaggaataaatgtacc

SEQ ID NO: 1608 - DNA, 20 bp, Artificial
  Antisense Oligonucleotides
tgttattaaattaggaataa

SEQ ID NO: 1609 - DNA, 18 bp, Artificial
  Antisense Oligonucleotides
gcatgttattaaattagg

SEQ ID NO: 1610 - DNA, 18 bp, Artificial
  Antisense Oligonucleotides
tatattatacattaactg

SEQ ID NO: 1611 - DNA, 19 bp, Artificial
  Antisense Oligonucleotides
ttatatatagttttatgaa

SEQ ID NO: 1612 - DNA, 19 bp, Artificial
  Antisense Oligonucleotides
tcattaggtgtaaggaaaa

SEQ ID NO: 1613 - DNA, 19 bp, Artificial
  Antisense Oligonucleotides
gtttatttgtttgtaaatg

SEQ ID NO: 1614 - DNA, 20 bp, Artificial
  Antisense Oligonucleotides
ctgaaataggttaaaatatt

SEQ ID NO: 1615 - DNA, 18 bp, Artificial
  Antisense Oligonucleotides
atatcaagtttcaggtat

SEQ ID NO: 1616 - DNA, 17 bp, Artificial
  Antisense Oligonucleotides
gctggagagatatattt

SEQ ID NO: 1617 - DNA, 20 bp, Artificial
  Antisense Oligonucleotides
agctgaaagagaaaaacatg

SEQ ID NO: 1618 - DNA, 19 bp, Artificial
  Antisense Oligonucleotides
agctgaaagagaaaaacat

SEQ ID NO: 1619 - DNA, 20 bp, Artificial
  Antisense Oligonucleotides
aagctgaaagagaaaaacat

SEQ ID NO: 1620 - DNA, 19 bp, Artificial
  Antisense Oligonucleotides
tggattggtttattgcttt

SEQ ID NO: 1621 - DNA, 17 bp, Artificial
  Antisense Oligonucleotides
catgtactgtgtgagcc

SEQ ID NO: 1622 - DNA, 17 bp, Artificial
  Antisense Oligonucleotides
ccatgtactgtgtgagc

SEQ ID NO: 1623 - DNA, 17 bp, Artificial
  Antisense Oligonucleotides
tatttacttgatgggta

SEQ ID NO: 1624 - DNA, 18 bp, Artificial
  Antisense Oligonucleotides
atatttacttgatgggta

SEQ ID NO: 1625 - DNA, 19 bp, Artificial
  Antisense Oligonucleotides
aatatttacttgatgggta

SEQ ID NO: 1626 - DNA, 18 bp, Artificial
  Antisense Oligonucleotides
aatatttacttgatgggt

SEQ ID NO: 1627 - DNA, 18 bp, Artificial
  Antisense Oligonucleotides
aacaatggaataagtaga

SEQ ID NO: 1628 - DNA, 19 bp, Artificial
  Antisense Oligonucleotides
ctcctgataatatattggc

SEQ ID NO: 1629 - DNA, 17 bp, Artificial
  Antisense Oligonucleotides
tagagtggtgaggtgag

SEQ ID NO: 1630 - DNA, 18 bp, Artificial
  Antisense Oligonucleotides
cctattttcaattattcc

SEQ ID NO: 1631 - DNA, 19 bp, Artificial
  Antisense Oligonucleotides
aagagatcaacagtggacc

SEQ ID NO: 1632 - DNA, 18 bp, Artificial
  Antisense Oligonucleotides
ttgggaataaatttcagc

SEQ ID NO: 1633 - DNA, 17 bp, Artificial
  Antisense Oligonucleotides
tactgtatgaatgtaac

SEQ ID NO: 1634 - DNA, 17 bp, Artificial
  Antisense Oligonucleotides
agaagccccatttaagc

SEQ ID NO: 1635 - DNA, 18 bp, Artificial
  Antisense Oligonucleotides
attaagagaagccccatt

SEQ ID NO: 1636 - DNA, 19 bp, Artificial
  Antisense Oligonucleotides
tattaagagaagccccatt

SEQ ID NO: 1637 - DNA, 17 bp, Artificial
  Antisense Oligonucleotides
attaagagaagccccat

SEQ ID NO: 1638 - DNA, 18 bp, Artificial
  Antisense Oligonucleotides
tattaagagaagccccat

SEQ ID NO: 1639 - DNA, 19 bp, Artificial
  Antisense Oligonucleotides
ctattaagagaagccccat

SEQ ID NO: 1640 - DNA, 17 bp, Artificial
  Antisense Oligonucleotides
tattaagagaagcccca

SEQ ID NO: 1641 - DNA, 18 bp, Artificial
  Antisense Oligonucleotides
ctattaagagaagcccca

SEQ ID NO: 1642 - DNA, 17 bp, Artificial
  Antisense Oligonucleotides
ctattaagagaagcccc

SEQ ID NO: 1643 - DNA, 18 bp, Artificial
  Antisense Oligonucleotides
cctattaagagaagcccc

SEQ ID NO: 1644 - DNA, 17 bp, Artificial
  Antisense Oligonucleotides
cctattaagagaagccc

SEQ ID NO: 1645 - DNA, 18 bp, Artificial
  Antisense Oligonucleotides
gcctattaagagaagccc

SEQ ID NO: 1646 - DNA, 17 bp, Artificial
  Antisense Oligonucleotides
gcctattaagagaagcc

SEQ ID NO: 1647 - DNA, 18 bp, Artificial
  Antisense Oligonucleotides
catttggaatacagggtg

SEQ ID NO: 1648 - DNA, 17 bp, Artificial
  Antisense Oligonucleotides
catttggaatacagggt

SEQ ID NO: 1649 - DNA, 18 bp, Artificial
  Antisense Oligonucleotides
atttacttttgatgtgaa

SEQ ID NO: 1650 - DNA, 18 bp, Artificial
  Antisense Oligonucleotides
tttaaatttcagcttgac

SEQ ID NO: 1651 - DNA, 18 bp, Artificial
  Antisense Oligonucleotides
atttgttaaaagctctga

SEQ ID NO: 1652 - DNA, 18 bp, Artificial
  Antisense Oligonucleotides
tatgtataagagatgttt

SEQ ID NO: 1653 - DNA, 18 bp, Artificial
  Antisense Oligonucleotides
atgcactcagaaacatgc

SEQ ID NO: 1654 - DNA, 19 bp, Artificial
  Antisense Oligonucleotides
tcatgcactcagaaacatg

SEQ ID NO: 1655 - DNA, 18 bp, Artificial
  Antisense Oligonucleotides
tcatgcactcagaaacat

SEQ ID NO: 1656 - DNA, 19 bp, Artificial
  Antisense Oligonucleotides
ttcatgcactcagaaacat

SEQ ID NO: 1657 - DNA, 17 bp, Artificial
  Antisense Oligonucleotides
gttgaagtgtaaacaat

SEQ ID NO: 1658 - DNA, 17 bp, Artificial
  Antisense Oligonucleotides
tgatgaagagttgtact

SEQ ID NO: 1659 - DNA, 18 bp, Artificial
  Antisense Oligonucleotides
gatgtgaatttttccagt

SEQ ID NO: 1660 - DNA, 18 bp, Artificial
  Antisense Oligonucleotides
acaggataaagaaaagag

SEQ ID NO: 1661 - DNA, 20 bp, Artificial
  Antisense Oligonucleotides
attataaacctttaaaatct

SEQ ID NO: 1662 - DNA, 17 bp, Artificial
  Antisense Oligonucleotides
aggactgtgaattacta

SEQ ID NO: 1663 - DNA, 18 bp, Artificial
  Antisense Oligonucleotides
atcagaaaagcttcaacc

SEQ ID NO: 1664 - DNA, 19 bp, Artificial
  Antisense Oligonucleotides
tatcagaaaagcttcaacc

SEQ ID NO: 1665 - DNA, 20 bp, Artificial
  Antisense Oligonucleotides
ttatcagaaaagcttcaacc

SEQ ID NO: 1666 - DNA, 18 bp, Artificial
  Antisense Oligonucleotides
tatcagaaaagcttcaac

SEQ ID NO: 1667 - DNA, 19 bp, Artificial
  Antisense Oligonucleotides
ttatcagaaaagcttcaac

SEQ ID NO: 1668 - DNA, 20 bp, Artificial
  Antisense Oligonucleotides
attatcagaaaagcttcaac

SEQ ID NO: 1669 - DNA, 19 bp, Artificial
  Antisense Oligonucleotides
attatcagaaaagcttcaa

SEQ ID NO: 1670 - DNA, 19 bp, Artificial
  Antisense Oligonucleotides
taattatcagaaaagcttc

SEQ ID NO: 1671 - DNA, 18 bp, Artificial
  Antisense Oligonucleotides
taattatcagaaaagctt

SEQ ID NO: 1672 - DNA, 18 bp, Artificial
  Antisense Oligonucleotides
ttgtgtaataattatcag

SEQ ID NO: 1673 - DNA, 20 bp, Artificial
  Antisense Oligonucleotides
tagaagataataaatgtgta

SEQ ID NO: 1674 - DNA, 17 bp, Artificial
  Antisense Oligonucleotides
atatacagtgtcccatg

SEQ ID NO: 1675 - DNA, 18 bp, Artificial
  Antisense Oligonucleotides
tatatacagtgtcccatg

SEQ ID NO: 1676 - DNA, 17 bp, Artificial
  Antisense Oligonucleotides
tatatacagtgtcccat

SEQ ID NO: 1677 - DNA, 18 bp, Artificial
  Antisense Oligonucleotides
taactcttaaatatatca

SEQ ID NO: 1678 - DNA, 19 bp, Artificial
  Antisense Oligonucleotides
ttaactcttaaatatatca

SEQ ID NO: 1679 - DNA, 20 bp, Artificial
  Antisense Oligonucleotides
attaactcttaaatatatca

SEQ ID NO: 1680 - DNA, 19 bp, Artificial
  Antisense Oligonucleotides
attaactcttaaatatatc

SEQ ID NO: 1681 - DNA, 20 bp, Artificial
  Antisense Oligonucleotides
tattaactcttaaatatatc

SEQ ID NO: 1682 - DNA, 19 bp, Artificial
  Antisense Oligonucleotides
ttattaactcttaaatata

SEQ ID NO: 1683 - DNA, 20 bp, Artificial
  Antisense Oligonucleotides
tttattaactcttaaatata

SEQ ID NO: 1684 - DNA, 19 bp, Artificial
  Antisense Oligonucleotides
acaaatttattaactctta

SEQ ID NO: 1685 - DNA, 20 bp, Artificial
  Antisense Oligonucleotides
cacaaatttattaactctta

SEQ ID NO: 1686 - DNA, 19 bp, Artificial
  Antisense Oligonucleotides
cacaaatttattaactctt

SEQ ID NO: 1687 - DNA, 20 bp, Artificial
  Antisense Oligonucleotides
tcacaaatttattaactctt

SEQ ID NO: 1688 - DNA, 18 bp, Artificial
  Antisense Oligonucleotides
cacaaatttattaactct

SEQ ID NO: 1689 - DNA, 19 bp, Artificial
  Antisense Oligonucleotides
tcacaaatttattaactct

SEQ ID NO: 1690 - DNA, 20 bp, Artificial
  Antisense Oligonucleotides
atcacaaatttattaactct

SEQ ID NO: 1691 - DNA, 18 bp, Artificial
  Antisense Oligonucleotides
tcacaaatttattaactc

SEQ ID NO: 1692 - DNA, 19 bp, Artificial
  Antisense Oligonucleotides
atcacaaatttattaactc

SEQ ID NO: 1693 - DNA, 20 bp, Artificial
  Antisense Oligonucleotides
aatcacaaatttattaactc

SEQ ID NO: 1694 - DNA, 20 bp, Artificial
  Antisense Oligonucleotides
cagaaatcacaaatttatta

SEQ ID NO: 1695 - DNA, 20 bp, Artificial
  Antisense Oligonucleotides
gcagaaatcacaaatttatt

SEQ ID NO: 1696 - DNA, 19 bp, Artificial
  Antisense Oligonucleotides
gcagaaatcacaaatttat

SEQ ID NO: 1697 - DNA, 20 bp, Artificial
  Antisense Oligonucleotides
agcagaaatcacaaatttat

SEQ ID NO: 1698 - DNA, 19 bp, Artificial
  Antisense Oligonucleotides
agcagaaatcacaaattta

SEQ ID NO: 1699 - DNA, 20 bp, Artificial
  Antisense Oligonucleotides
cagcagaaatcacaaattta

SEQ ID NO: 1700 - DNA, 19 bp, Artificial
  Antisense Oligonucleotides
cagcagaaatcacaaattt

SEQ ID NO: 1701 - DNA, 20 bp, Artificial
  Antisense Oligonucleotides
tcagcagaaatcacaaattt

SEQ ID NO: 1702 - DNA, 19 bp, Artificial
  Antisense Oligonucleotides
tcagcagaaatcacaaatt

SEQ ID NO: 1703 - DNA, 20 bp, Artificial
  Antisense Oligonucleotides
gtcagcagaaatcacaaatt

SEQ ID NO: 1704 - DNA, 19 bp, Artificial
  Antisense Oligonucleotides
gtcagcagaaatcacaaat

SEQ ID NO: 1705 - DNA, 20 bp, Artificial
  Antisense Oligonucleotides
tgtcagcagaaatcacaaat

SEQ ID NO: 1706 - DNA, 18 bp, Artificial
  Antisense Oligonucleotides
gtcagcagaaatcacaaa

SEQ ID NO: 1707 - DNA, 19 bp, Artificial
  Antisense Oligonucleotides
tgtcagcagaaatcacaaa

SEQ ID NO: 1708 - DNA, 18 bp, Artificial
  Antisense Oligonucleotides
tgtcagcagaaatcacaa

SEQ ID NO: 1709 - DNA, 18 bp, Artificial
  Antisense Oligonucleotides
gagaggtaaatacaatct

SEQ ID NO: 1710 - DNA, 19 bp, Artificial
  Antisense Oligonucleotides
aggagaggtaaatacaatc

SEQ ID NO: 1711 - DNA, 18 bp, Artificial
  Antisense Oligonucleotides
taggaatgcaatgatgaa

SEQ ID NO: 1712 - DNA, 18 bp, Artificial
  Antisense Oligonucleotides
atcattctagtcactctg

SEQ ID NO: 1713 - DNA, 18 bp, Artificial
  Antisense Oligonucleotides
gtgtcatctatgtttacc

What is claimed is:

1. An antisense oligonucleotide (ASO) comprising a contiguous nucleotide sequence up to 30 nucleotides in length, wherein the contiguous nucleotide sequence comprises at least one non-naturally occurring nucleoside, wherein the ASO is capable of reducing calcium/calmodulin-dependent protein kinase type II delta (CAMK2D) protein and/or CAMK2D transcript expression in a human cell, and wherein the contiguous nucleotide sequence comprises the sequence set forth in SEQ ID NO: 657, SEQ ID NO: 659, SEQ ID NO: 822, SEQ ID NO: 827, SEQ ID NO: 981, SEQ ID NO: 982, SEQ ID NO: 983, SEQ ID NO: 984, SEQ ID NO: 986, SEQ ID NO: 989, SEQ ID NO: 1247, SEQ ID NO: 1249, SEQ ID NO: 1326, SEQ ID NO: 1359, SEQ ID NO: 1363, SEQ ID NO: 1371, SEQ ID NO: 1387, SEQ ID NO: 1389, SEQ ID NO: 1390, SEQ ID NO: 1409, SEQ ID NO: 1415, SEQ ID NO: 1420, or SEQ ID NO: 1429.

2. The ASO of claim 1, wherein the ASO is a gapmer.

3. The ASO of claim 1, wherein the non-naturally occurring nucleoside is a sugar modified nucleoside.

4. The ASO of claim 3, wherein the non-naturally occurring nucleoside comprises a 2'-O-alkyl-RNA; 2'-O-methyl RNA (2'-OMe); 2'-alkoxy-RNA; 2'-O-methoxyethyl-RNA (2'-MOE); 2'-amino-DNA; 2'-fluoro-RNA; 2'-fluoro-DNA; arabino nucleic acid (ANA); 2'-fluoro-ANA; or bicyclic nucleoside analog (LNA).

5. The ASO of claim 3, wherein the sugar modified nucleoside is an affinity enhancing 2' sugar modified nucleoside.

6. The ASO of claim 5, wherein the affinity enhancing 2' sugar modified nucleoside is an LNA.

7. The ASO of claim 1, wherein the ASO comprises one or more 5'-methyl-cytosine nucleobases.

8. The ASO of claim 1, wherein the contiguous nucleotide sequence comprises one or more modified internucleoside linkages.

9. The ASO of claim 8, wherein the one or more modified internucleoside linkages is a phosphorothioate linkage.

10. A conjugate comprising the ASO of claim 1, wherein the ASO is covalently attached to at least one non-nucleotide or non-polynucleotide moiety.

11. A pharmaceutical composition comprising the ASO of claim 1 and a pharmaceutically acceptable diluent, carrier, salt, or adjuvant.

12. A kit comprising the ASO of claim 1 and instructions for use.

13. The ASO of claim 6, wherein the LNA is constrained ethyl nucleoside (cEt), 2',4'-constrained $2^1$-O-methoxyethyl (cMOE), α-L-LNA, β-D-LNA, 2'-0,4'-C-ethylene-bridged nucleic acids (ENA), amino-LNA, oxy-LNA, thio-LNA, or any combination thereof.

14. The ASO of claim 6, wherein the LNA is β-D-LNA or oxy-LNA.

15. The ASO of claim 1, wherein the contiguous nucleotide sequence comprises the sequence set forth in SEQ ID NO: 1390.

16. The ASO of claim 1, wherein the contiguous nucleotide sequence comprises the sequence set forth in SEQ ID NO: 657 or SEQ ID NO: 659.

17. The ASO of claim 1, wherein the ASO is capable of reducing CAMK2D protein and/or CAMK2D transcript expression in the human cell by at least about 20% compared to a corresponding cell not exposed to the ASO.

* * * * *

UNITED STATES PATENT AND TRADEMARK OFFICE
CERTIFICATE OF CORRECTION

PATENT NO. : 11,058,767 B2
APPLICATION NO. : 16/282138
DATED : July 13, 2021
INVENTOR(S) : Olson et al.

It is certified that error appears in the above-identified patent and that said Letters Patent is hereby corrected as shown below:

On the Title Page

Column 1, Item (73), in "Assignees", Line 4, delete "Horsholm" and insert -- Hørsholm --, therefor.

In the Specification

In Column 1, Lines 44-45, delete "*Am J Physiol Heart Circ Physiol*" and insert -- *Am. J. Physiol. Heart Circ. Physiol.* --, therefor.

In Column 1, Lines 48-49, delete "*Am J Physiol Heart Circ Physiol*" and insert -- *Am. J. Physiol. Heart Circ. Physiol.* --, therefor.

In Column 1, Line 60, delete "*Am J Physiol Heart Circ Physiol*" and insert -- *Am. J. Physiol. Heart Circ. Physiol.* --, therefor.

In Column 8, Line 40, delete "cyploroyl." and insert -- cyclopropyl. --, therefor.

In Column 24, Line 17, delete "vol" and insert -- Vol. --, therefor.

In Column 26, Line 12, delete "Vol" and insert -- Vol. --, therefor.

In Column 26, Line 21, delete "-($CR^aR^b$)-$CR^aR^b$-O-$CR^aR^b$-," and insert -- -($CR^aR^b$)$_n$-, $CR^aR^b$-O-$CR^aR^b$-, --, therefor.

In Column 26, Line 52, delete "-NRc;" and insert -- -$NR^c$; --, therefor.

Signed and Sealed this
Twenty-second Day of February, 2022

Drew Hirshfeld
*Performing the Functions and Duties of the
Under Secretary of Commerce for Intellectual Property and
Director of the United States Patent and Trademark Office*

In Column 27, Lines 51-55, delete " 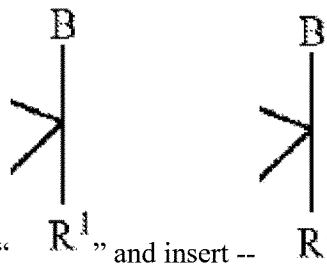 " and insert -- -- , therefor.

In Column 29, Line 22, delete "Vol" and insert -- Vol. --, therefor.

In Column 29, Line 37, delete "*Chem*" and insert -- *Chem.* --, therefor.

In Column 30, Line 4, delete "*Chem*" and insert -- *Chem.* --, therefor.

In Column 30, Line 10, delete "*Chem*" and insert -- *Chem.* --, therefor.

In Column 31, Lines 15-20, delete " 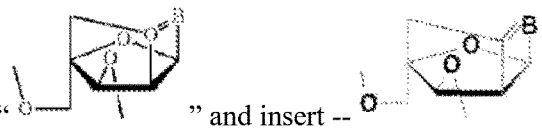 " and insert -- -- , therefor.

In Column 35, Line 8, delete "salt" and insert -- salt. --, therefor.

In Column 36, Line 9, delete "*J Pharm Pharmacol*" and insert -- *J. Pharm. Pharmacol.* --, therefor.

In Column 36, Line 9, delete "54(0:3-27)." and insert -- 54(1):3-27). --, therefor.

In Column 41, Line 6, delete "*Circ Res*" and insert -- *Circ. Res.* --, therefor.

In Column 41, Lines 12-13, delete "*Prog Biophys Mol Biol*" and insert -- *Prog. Biophys. Mol. Biol.* --, therefor.

In Column 41, Line 50, delete "(12.05" and insert -- (12.05 μL), --, therefor.

In Column 41, Line 51, delete "(6.65" and insert -- (6.65 μL), --, therefor.

In Column 41, Line 51, delete "(1" and insert -- (1 μL), --, therefor.

In the Claims

In Column 44, Claim 13, Line 29, delete "$2^1$-O-methoxyethyl" and insert -- 2'-O-methoxyethyl --, therefor.